US007700359B2

(12) United States Patent
Chan et al.

(10) Patent No.: US 7,700,359 B2
(45) Date of Patent: Apr. 20, 2010

(54) GENE PRODUCTS DIFFERENTIALLY EXPRESSED IN CANCEROUS CELLS

(75) Inventors: Vivien W. Chan, Emeryville, CA (US); Jaime Escobedo, Emeryville, CA (US); Pablo Dominguez Garcia, Emeryville, CA (US); Rhonda Hansen, Emeryville, CA (US); Joerg Kaufmann, Emeryville, CA (US); Giulia C. Kennedy, Emeryville, CA (US); George Lamson, Emeryville, CA (US); Edward J. Moler, Emeryville, CA (US); Filippo Randazzo, Emeryville, CA (US); Christoph Reinhard, Emeryville, CA (US); Julie Sudduth-Klinger, Emeryville, CA (US)

(73) Assignee: Novartis Vaccines and Diagnostics, Inc., Emeryville, CA (US)

( * ) Notice: Subject to any disclaimer, the term of this patent is extended or adjusted under 35 U.S.C. 154(b) by 463 days.

(21) Appl. No.: 10/948,737

(22) Filed: Sep. 22, 2004

(65) Prior Publication Data

US 2007/0010469 A1    Jan. 11, 2007

Related U.S. Application Data

(63) Continuation-in-part of application No. 10/616,900, filed on Jul. 9, 2003, now abandoned, which is a continuation of application No. 09/872,850, filed on Jun. 1, 2001, now abandoned, application No. 10/948,737, which is a continuation-in-part of application No. 10/081,519, filed on Feb. 21, 2002, now abandoned, application No. 10/948,737, which is a continuation-in-part of application No. 10/310,673, filed on Dec. 4, 2002, now abandoned, application No. 10/948,737, which is a continuation-in-part of application No. 10/501,187, filed as application No. PCT/US03/00657 on Jan. 8, 2003, application No. 10/948,737, which is a continuation-in-part of application No. 10/081,124, filed on Feb. 21, 2002, now abandoned, application No. 10/948,737, which is a continuation-in-part of application No. PCT/US2004/015421, filed on May 13, 2004.

(60) Provisional application No. 60/208,871, filed on Jun. 2, 2000, provisional application No. 60/270,959, filed on Feb. 21, 2001, provisional application No. 60/336,613, filed on Dec. 4, 2001, provisional application No. 60/345,637, filed on Jan. 8, 2002, provisional application No. 60/270,855, filed on Feb. 21, 2001, provisional application No. 60/475,872, filed on Jun. 3, 2003.

(51) Int. Cl.
*C12Q 1/68* (2006.01)
*G01N 33/53* (2006.01)

(52) U.S. Cl. .......................... 436/6; 435/7.1

(58) Field of Classification Search .................. None
See application file for complete search history.

(56) References Cited

U.S. PATENT DOCUMENTS

| 4,683,195 | A |  | 7/1987 | Mullis et al. |
| 4,683,202 | A |  | 7/1987 | Mullis |
| 4,777,127 | A |  | 10/1988 | Suni et al. |
| 4,959,314 | A |  | 9/1990 | Mark et al. |
| 5,010,175 | A |  | 4/1991 | Rutter et al. |
| 5,124,246 | A |  | 6/1992 | Urdea et al. |
| 5,149,655 | A |  | 9/1992 | McCabe et al. |
| 5,206,152 | A |  | 4/1993 | Sukhatme |
| 5,219,740 | A |  | 6/1993 | Miller et al. |
| 5,422,120 | A |  | 6/1995 | Kim |
| 5,556,752 | A |  | 9/1996 | Lockhart et al. |
| 5,578,832 | A |  | 11/1996 | Trulson et al. |
| 5,580,859 | A |  | 12/1996 | Felgner et al. |
| 5,593,839 | A |  | 1/1997 | Hubbell et al. |
| 5,599,695 | A |  | 2/1997 | Pease et al. |
| 5,631,734 | A |  | 5/1997 | Stern et al. |
| 5,654,173 | A |  | 8/1997 | Jacobs et al. |
| 5,707,829 | A |  | 1/1998 | Jacobs et al. |
| 5,807,522 | A |  | 9/1998 | Brown et al. |
| 5,814,482 | A |  | 9/1998 | Dubensky, Jr. et al. |
| 6,020,135 | A |  | 2/2000 | Levine et al. |
| 6,500,938 | B1 |  | 12/2002 | Au-Young et al. |
| 2002/0182191 | A1 |  | 12/2002 | Xu et al. |
| 2003/0124128 | A1* |  | 7/2003 | Lillie et al. ............ 424/155.1 |

FOREIGN PATENT DOCUMENTS

| EP | 0 345 242 | 6/1989 |
| EP | 0 524 968 | 6/1995 |
| EP | 721 016 | 7/1996 |
| EP | 728 520 | 5/2001 |
| EP | 785 280 | 4/2003 |
| EP | 799 897 | 6/2006 |
| GB | 2 200 651 | 8/1988 |
| WO | WO 90/07936 | 7/1990 |
| WO | WO 90/11092 | 10/1990 |
| WO | WO 91/02805 | 3/1991 |

(Continued)

OTHER PUBLICATIONS

Wu et al, GenBank® AF214006 (Dec. 1, 2001).*
U.S. Appl. No. 60/252,358.
Altschul et al., "Gapped Blast and PSI-Blast: a new generation of protein database search programs," *Nucl. Acids Res.*, 1997, 25(17):3389-3402.
Alberts et al., *Molecular Biology of the Cell*, 1994, Garland Publishing, pp. 1-2.

(Continued)

*Primary Examiner*—James Martinell
(74) *Attorney, Agent, or Firm*—Mark Seka; Patricia Tsao

(57) ABSTRACT

The present invention provides polynucleotides, as well as polypeptides encoded thereby, that are differentially expressed in cancer cells. These polynucleotides are useful in a variety of diagnostic and therapeutic methods. The present invention further provides methods of reducing growth of cancer cells. These methods are useful for treating cancer.

9 Claims, 27 Drawing Sheets

FOREIGN PATENT DOCUMENTS

| WO | WO 91/14445 | 10/1991 |
| --- | --- | --- |
| WO | WO 91/17823 | 11/1991 |
| WO | WO 92/02526 | 2/1992 |
| WO | WO 92/11033 | 7/1992 |
| WO | WO 93/03769 | 3/1993 |
| WO | WO 93/10218 | 5/1993 |
| WO | WO 93/11230 | 6/1993 |
| WO | WO 93/14778 | 8/1993 |
| WO | WO 93/19191 | 9/1993 |
| WO | WO 93/25234 | 12/1993 |
| WO | WO 93/25698 | 12/1993 |
| WO | WO 94/03622 | 2/1994 |
| WO | WO 94/12649 | 6/1994 |
| WO | WO 94/23697 | 10/1994 |
| WO | WO 94/28938 | 12/1994 |
| WO | WO 95/00655 | 1/1995 |
| WO | WO 95/07994 | 3/1995 |
| WO | WO 95/11984 | 5/1995 |
| WO | WO 95/13796 | 5/1995 |
| WO | WO 95/22058 | 8/1995 |
| WO | WO 95/30763 | 11/1995 |
| WO | WO 96/17072 | 6/1996 |
| WO | WO 97/02357 | 1/1997 |
| WO | WO 97/27317 | 7/1997 |
| WO | WO 97/29212 | 8/1997 |
| WO | WO 97/42338 | 11/1997 |
| WO | WO 99/21994 | 5/1999 |
| WO | WO 01/68846 | 9/2001 |
| WO | WO 02/12328 | 2/2002 |
| WO | WO-03004989 A2 * | 1/2003 |

OTHER PUBLICATIONS

Attwood, "The Babel of Bioinformatics," *Science*, 2000, 290:471-473.

Bodmer et al., "Genetic steps in colorectal cancer," *Nat. Genet.*, 1994, 6:217-219.

Brinkley et al., "Variations in Cell From and Cytoskeleton in Human Breast Carcinoma Cells in Vitro," *Cancer Res.*, 1980, 40:3118-3129.

Brutlag et al., "Blaze™: An Implementation of the Smith-Waterman Sequence Comparison Algorithm on a Massively Parallel Computer," *Comp. Chem.*, 1993, 17(2):203-207.

Cailleau et al., "Breast Tumor Cell Lines from Pleural Effusions," *J. Natl. Cancer Inst.*, 1974, 53(3):661-666.

Chandrasekaran and Davidson, "Glycosaminoglycans of Normal and Malignant Cultured Human Mammary Cells," *Cancer Res.*, 1979, 39:870-880.

Chaturvedi et al., "Stabilization of triple-stranded oligonucleotide complexes: use of probes containing alternating phosphodiester and stereo-uniform cationic phosphoramidate linkages," *Nucl. Acids Res.*, 1996, 24(12):2318-2323.

Clarke and Fersht, "Engineered Disulfide Bonds as Probes of the Folding Pathway of Barnase: Increasing the Stability of Proteins against the Rate of Denaturation," *Biochemistry*, 1993, 32:4322-4329.

Claverie "Effective Large-Scale Sequence Similarity Searches," *Meth. Enzymol.*, 1996, 266:212-227.

Claverie and States, "Information Enhancement Methods for Large Scale Sequence Analysis," *Comput. Chem.*, 1993, 17(2):191-201.

Claverie, *Automated DNA Sequencing and Analysis*, 1994, Adams et al. (eds.), Chapter 36, pp. 269-279, Academic Press.

Conia et al., "The Micro-Robotic Laboratory: Optical Trapping and Scissing for the Biologist," *J. Clin. Lab. Anal.*, 1997, 11:28-38.

Connelly et al., "In Vivo Gene Delivery and Expression of Physiological Levels of Functional Human Factor VIII in Mice," *Hum. Gene Ther.*, 1995, 6:185-193.

Curiel et al., "High-Efficiency Gene Transfer Mediated by Adenovirus Coupled to DNA-Polylysine Complexes," *Hum. Gene Ther.*, 1992, 3:147-154.

Curran et al., "Laser capture microscopy," *J. Clin. Pathol.: Mol. Pathol.*, 2000, 53:64-68.

Emmert-Buck et al., "Laser Capture Microdissection," *Science*, 1996, 274:998-1001.

Fearon, "Molecular Genetics of Colorectal Cancer," *Ann. NY Acad. Sci.*, 1995, 768:101-110.

Fearon and Vogelstein, "A Genetic Model for Colorectal Tumorigenesis," *Cell*, 1990, 61:759-767.

Findeis et al., "Targeted delivery of DNA for gene therapy via receptors," *Trends Biotechnol.*, 1993, 11:202-205.

Gastpar et al., "Methoxy-Substituted 3-Formyl-2-phenylindoles Inhibit Tubulin Polymerization," *J. Med. Chem.*, 1998, 41:4965-4972.

Gerhold and Caskey, "It's the genes! EST access to human genome content," *BioEssays*, 1996, 18(12):973-981.

Gō and Miyazawa, "Relationship Between Mutability, Polarity and Exteriority of Amino Acid Residues in Protein Evolution," *Int. J. Peptide Protein Res.*, 1980, 15:211-224.

Haezebrouck et al., "Stability effects associated with the introduction of a partial and a complete $Ca^{2+}$-binding site into human lysozyme," *Protein Eng.*, 1993, 6(6):643-649.

Hamilton and Kern, "Molecular Genetic Alterations as Potential Prognostic Indicators in Colorectal Carcinoma and Molecular Genetics of Colorectal Carcinoma," *Cancer*, 1993, 72:957.

Hanahan and Weinberg, "The Hallmarks of Cancer," *Cell*, 2000, 100:57-70.

Hashido et al., "Truncation of N-Terminal Extracellular or C-Terminal Intracellular Domains of Human $ET_A$ Receptor Abrogated the Binding Activity to ET-1," *Biochem. Biophys. Res. Comm.*, 1992, 187(3):1241-1248.

Jolly, "Viral vector systems for gene therapy," *Cancer Gene Therapy*, 1994, 1:51-64.

Kaplitt et al., "Long-term gene expression and phenotypic correction using adeno-associated virus vectors in the mammalian brain," *Nat. Genet.*, 1994, 8:148-154.

Kelner et al., "Nonresponsiveness of the Metastatic Human Lung Carcinoma MV522 Xenograft to Conventional Anticancer Agents," *Anticancer Res.*, 1995, 15:867-872.

Kimura et al., "Retroviral Delivery of DNA into the Livers of Transgenic Mice Bearing Premalignant and Malignant Hepatocellular Carcinomas," *Hum. Gene Ther.*, 1994, 5:845-852.

Kuang et al., "Differential screening and suppression subtractive hybridization identified genes differentially expressed in an estrogen receptor-positive breast carcinoma cell line," *Nucl. Acids Res.*, 1998, 26(4):1116-1123.

Lopez et al., "Identification of putative chromosomal origins of replication in Archaea," *Mol. Microbiol.*, 1999, 32(4):883-886.

Luo et al., "Gene expression profiles of laser-captured adjacent neuronal subtypes," *Nat. Med.*, 1999, 5:117-122.

Masui et al., "Stabilization and Rational Design of Serine Protease AprM under Highly Alkaline and High-Temperature Conditions," *Appl. Env. Microbiol.*, 1994, 60(10):3579-3584.

Morikawa et al., "In Vivo Selection of Highly Metastatic Cells from Surgical Specimens of Different Primary Human Colon Carcinomas Implanted into Nude Mice," *Cancer Res.*, 1988, 48:1943-1948.

Morikawa et al., "Influence of Organ Environment on the Growth, Selection, and Metastasis of Human Colon Carcinoma Cells in Nude Mice," *Cancer Res.*, 1988, 48:6863-6871.

Mullis and Faloona, "Specific Synthesis of DNA in Vitro via a Polymerase-Catalyzed Chain Reaction," *Meth. Enzymol.*, 1987, 155:335-372.

Niwa et al., "A Role for Presenilin-1 in Nuclear Accumulation of Ire1 Fragments and Induction of the Mammalian Unfolded Protein Response," *Cell*, 1999, 99:691-702.

Ohyama et al., "Laser Capture Microdissection-Generated Target Sample for High-Density Oligonucleotide Array Hybridization," *Biotechniques*, 2000, 29(3):530-536.

Olsen and Thomsen, "Improvement of bacterial β-glucanase thermostability by glycosylation," *J. Gen. Microbiol.*, 1991, 137:579-585.

Pappalardo et al., "Microdissection, Microchip Arrays, and Molecular Analysis of Tumor Cells (Primary and Matastases)," *Sem. Radiation Oncol.*, 1998, 8(3):217-223.

Peyrottes et al., "Oligodeoxynucleoside phosphoramidates (P-NH$_2$): synthesis and thermal stability of duplexes with DNA and RNA targets," *Nucl. Acids Res.*, 1996, 24(10):1841-1848.

Philip et al., "Efficient and Sustained Gene Expression in Primary T Lymphocytes and Primary and Cultured Tumor Cells Mediated by Adeno-Associated Virus Plasmid DNA Complexed to Cationic Liposomes," *Mol. Cell. Biol.*, 1994, 14(4):2411-2418.

Querol et al., "Analysis of protein conformational characteristics related to thermostability," *Prot. Eng.*, 1996, 9(3):265-271.

Radinsky et al., "Level and Function of Epidermal Growth Factor Receptor Predict the metastatic Potential of Human Colon Carcinoma Cells," *Clin. Cancer Res.*, 1995, 1:19-31.

Ramsay, "DNA chips: State-of-the art," *Nat. Biotechnol.*, 1998, 16:40-44.

Ranson et al., "Increased plasminogen binding is associated with metastatic breast cancer cells: differential expression of plasminogen binding proteins," *Br. J. Cancer*, 1998, 77(10):1586-1597.

Russell and Barton, "Structural Features can be Unconserved in Proteins with Similar Folds. An Analysis of Side-chain to Side-chain Contacts Secondary Structure and Accessibility," *J. Mol. Biol.*, 1994, 244:332-350.

Saiki et al., "Primer-Directed Enzymatic Amplification of DNA with a Thermostable DNA Polymerase," *Science*, 1988, 239:487-491.

Sambrook et al., "In Vitro Amplification of DNA by the Polymerase Chain Reaction," *Molecular Cloning: A Laboratory Manual*, 1989, CSH Press, pp. 14.2-14.33.

Schena et al., "Quantitative Monitoring of Gene Expression Patterns with a Complementary DNA Microarray," *Science*, 1995, 270(5235):467-470.

Schena et al., "Parallel human genome analysis: Microarray-based expression monitoring of 1000 genes," *Proc. Natl. Acad. Sci. USA*, 1996, 93(20):10614-10619.

Shalon et al., "A DNA Microarray System for Analyzing Complex DNA Samples Using Two-color Fluorescent Probe Hybridization," *Genome Res.*, 1996, 6:639-645.

Simone et al., "Laser-capture microdissection: opening the microscopic frontier to molecular analysis," *Trends Genet.*, 1998, 14(7):272-276.

Suarez-Quian et al., "Laser Capture Microdissection of Single Cells from Complex Tissues," *BioTechniques*, 1999, 26(2):328-335.

Toma et al., "Grafting of a Calcium-Binding Loop of Thermolysin to *Bacillus subtilis* Neutral Protease," *Biochemistry*, 1991, 30:97-106.

Varki et al., "Cloned Low Metastatic Variants from Human Lung Carcinoma Metastases," *Anticancer Res.*, 1990, 10:637-644.

Varki et al., "Microscopic Metastasis of a Human Lung Carcinoma Cell Line in Athymic Nude Mice: Isolation of a Metastatic Variant," *Int. J. Cancer*, 1987, 40:46-52.

Varki et al., "Spontaneously Metastasizing Variants of a Human Lung Carcinoma Cell Line: Monoclonal Antibody Characterization," *Tumor Biol.*, 1990, 11:327-338.

Wakarchuk et al., "Thermostabilization of the *Bacillus circulans* xylanase by the introduction of disulfide bonds," *Protein Eng.*, 1994, 7(11):1379-1386.

Wells and Peitsch, "The chemokine information source: identification and characterization of novel chemokines using the WorldWideWeb and Expressed Sequence Tag Databases," *J. Leukocyte Biol.*, 1997, 61(5):545-550.

Woffendin et al., "Nonviral and viral delivery of a human immunodeficiency virus protective gene into primary human T cells," *Proc. Natl. Acad. Sci. USA*, 1994, 91(24):11581-11585.

Wu and Wu, "Receptor-mediated Gene Delivery and Expression in Vivo," *J. Biol. Chem.*, 1988, 263(29):14621-14624.

Wu et al., "Receptor-mediated Gene Delivery in Vivo. Partial Correction of Genetic Analbuminemia in Nagase Rats," *J. Biol. Chem.*, 1991, 266(22):14338-14342.

Wu et al., "Incorporation of Adenovirus into a Ligand-based DNA Carrier System Results in Retention of Original Receptor Specificity and Enhances Targeted Gene Expression," *J. Biol. Chem.*, 1994, 269(15):11542-11546.

Wu et al., "Targeting Genes: Delivery and Persistent Expression of a Foreign Gene Driven by Mammalian Regulatory Elements in Vivo," *J. Biol. Chem.*, 1989, 264(29):16985-16987.

Yeatman et al., "Identification of genetic alterations associated with the process of human experimental colon cancer liver metastasis in the nude mouse," *Clin. Exp. Metastasis*, 1996, 14:246-252.

Yeatman and Mao, "Identification of a differentially-expressed message associated with colon cancer liver metastasis using an improved method of differential display," *Nucl. Acids. Res.*, 1995, 23(19):4007-4008.

Zenke et al., Receptor-mediated endocytosis of transferrin-polycation conjugates: An efficient way to introduce DNA into hematopoietic cells, *Proc. Natl. Acad. Sci. USA*, 1990, 87:3655-3659.

Zhang et al., "Anti-tumor efficacy and biodistribution of intravenous polymeric micellar paclitaxel," *Anti-Cancer Drugs*, 1997, 8:696-701.

NCBI Genbank Database entry NM.001536, published to the World Wide website of the National Center for Biotechnology Information.

NCBI OMIM Database entry 602950, published to the World Wide website of the National Center for Biotechnology Information.

Vacarro, et al., VMP1 Expression Correlates with Acinar Cell Cytoplasmic Vacuolization in Arginine-Incuded Acute Pancreatitis. Pancreatology, 2003 vol. 3, pp. 69-74.

Dusetti, et al., Cloning and Expression of the rat Vacuole Membrane Protein 1 (VMP1), a new Gene Activated in Pancreas with Acute Pancreatitis. Biochemical and Biophysical Research Communications, 2002 vol. 290, pp. 641-649.

Zhuang, et al., Accession No. AF362074, Direct submission, available Jun. 20, 2001.

Bonaldo, et al., "Normalization and subtraction: two approaches to facilitate gene discovery." Genome Research. Sep. 1996, vol. 6, No. 9, pp. 791-806.

Haynes, et al., "Proteome analysis: Biological assay or data archive?" Electrophoresis. 1998, vol. 19, pp. 1862-1871, especially pp. 1863, 2$^{nd}$ para., and Fig. 1.

* cited by examiner

Group 1

Group 1
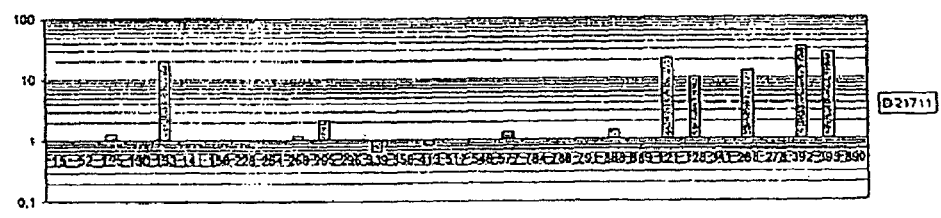
Fig. 6
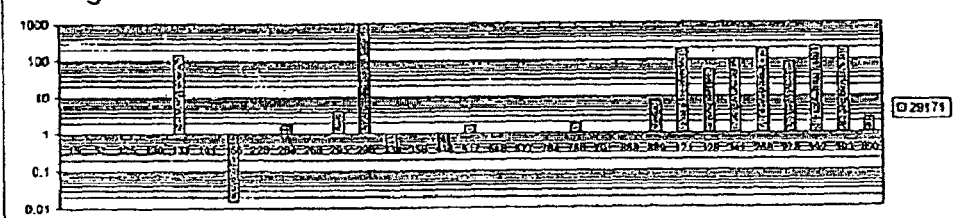
Fig. 7
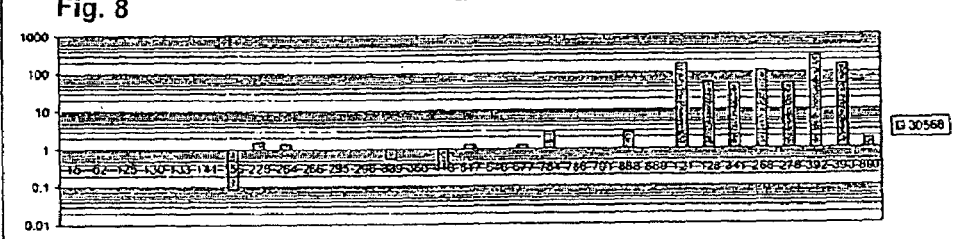
Fig. 8
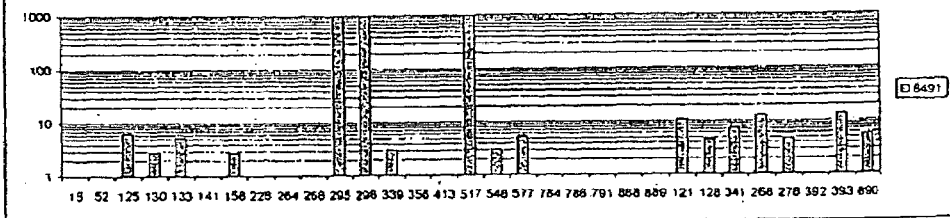
Fig. 9
Figures 6-9

Group 1

Group 1

Group 2

| Patient Type | # Patients | > 2x | > 5x | < 0.5 x |
|---|---|---|---|---|
| Colon Patient Set | 65 | 9 | 2 | 2 |
| Matched Colon Met Patient Set | 27 | 11 | 4 | 0 |
| Unmatched Colon Met Patient Set | 33 | 0 | 0 | 0 |
| Prostate Patient Set | 100 | 32 | 1 | 4 |
| Breast Patient Set | 23 | 0 | 0 | 43 |
| Stomach Patient Set | 7 | 14 | 0 | 0 | percentages:

Fig.22

| CHIR-210-1 | GGAGTGAACAAGAAGCCCAGATTGC | SEQ. ID NO. 13997 |
|---|---|---|
| CHIR-210-2 | AAGGTCGCTCTGCTTCACGCCA | SEQ. ID NO. 13998 |
| CHIR-210-3 | TGGATGAAGTTGGCGAAGGACACC | SEQ. ID NO. 13999 |
| CHIR-210-4 | TCGGAGGAGGTTTTCGGGCTTGG | SEQ. ID NO. 14000 |
| CHIR-210-5 | CGCCAGAACTTGTTGAAGGTCAGG | SEQ ID NO. 14001 |
| CHIR-210-6 | CAGGCTGGTGTGGTTGGCGTACA | SEQ ID NO. 14002 |
| CHIR-210-7 | ACTGAGAAACTTGTCCAGAAACTCG | SEQ ID NO. 14003 |
| CHIR-210-8 | CGTCCTCGTCCAGAGTCTCCAGC | SEQ ID NO. 14004 |

Fig. 26

| | Sequence | Sense strand siRNA | Antisense strand siRNA |
|---|---|---|---|
| CHIR210-i1 | AAGTTTCTCAGTGCTGGCGTG;<br>SEQ. ID. NO. 14005 | GUUUCUCAGUGCUGGCGUGtt;<br>SEQ. ID. NO. 14006 | CACGCCAGCACUGAGAAACtt;<br>SEQ. ID. NO. 14007 |
| CHIR210-i2 | AAGCAGAAGCGACCTTCCCAGA;<br>SEQ. ID. NO. 14008 | GCAGAGCGACCUUCCCAGAtt;<br>SEQ. ID. NO. 14009 | UCUGGGAAGGUCGCUCUGCtt;<br>SEQ. ID. NO. 14010 |
| CHIR210-i3 | AACTGGAAGCGCGTGATGATC;<br>SEQ. ID. NO. 14011 | CUGGAAGCGCGUGAUGAUCtt;<br>SEQ. ID. NO. 14012 | GAUCAUCACGCGCUUCCAGtt;<br>SEQ. ID. NO. 14013 |
| CHIR210-i4 | AAGCGCGTGATGATCGTGCTG;<br>SEQ. ID. NO. 14014 | GCGCGUGAUGAUCGUGCUGtt;<br>SEQ. ID. NO. 14015 | CAGCACGAUCAUCACGCGCtt;<br>SEQ. ID. NO. 14016 |
| CHIR210-i5 | AACAAGTTCTGGCGCCGCTAC;<br>SEQ. ID. NO. 14017 | CAAGUUCUGGCGCCGCUACtt;<br>SEQ. ID. NO. 14018 | GUAGCGGCGCCAGAACUUGtt;<br>SEQ. ID. NO. 14019 |
| CHIR210-i6 | AAGGTCAAGCTCAAGAAGTAC;<br>SEQ. ID. NO. 14020 | GGUCAAGCUCAAGAAGUACtt;<br>SEQ. ID. NO. 14021 | GUACUUCUUGAGCUUGACCtt;<br>SEQ. ID. NO. 14022 |
| CHIR210-i7 | AAGCTCAAGAAGTACACCAAG;<br>SEQ. ID. NO. 14023 | GCUCAAGAAGUACACCAAGtt;<br>SEQ. ID. NO. 14024 | CUUGGUGUACUUCUUGAGCtt;<br>SEQ. ID. NO. 14025 |
| CHIR210-i8 | AAGAAGTACACCAAGTTCCTC;<br>SEQ. ID. NO. 14026 | GAAGUACACCAAGUUCCUCtt;<br>SEQ. ID. NO. 14027 | GAGGAACUUGGUGUACUUCtt;<br>SEQ. ID. NO. 14028 |
| CHIR210-i9 | AAGTACACCAAGTTCCTCTTC;<br>SEQ. ID. NO. 14029 | GUACACCAAGUUCCUCUUCtt;<br>SEQ. ID. NO. 14030 | GAAGAGGAACUUGGUGUACtt;<br>SEQ. ID. NO. 14031 |
| CHIR210-i10 | AAGTTCCTCTTCGTGCGCGAC;<br>SEQ. ID. NO. 14032 | GUUCCUCUUCGUGCGCGACtt;<br>SEQ. ID. NO. 14033 | GUCGCGCACGAAGAGGAACtt;<br>SEQ. ID. NO. 14034 |
| CHIR210-i11 | AAGTTCGAGCTGGAGAACGAG;<br>SEQ. ID. NO. 14035 | GUUCGAGCUGGAGAACGAGtt;<br>SEQ. ID. NO. 14036 | CUCGUUCUCCAGCUCGAACtt;<br>SEQ. ID. NO. 14037 |
| CHIR210-i12 | AACGAGGAGTTCTACCGCAAG;<br>SEQ. ID. NO. 14038 | CGAGGAGUUCUACCGCAAGtt;<br>SEQ. ID. NO. 14039 | CUUGCGGUAGAACUCCUCGtt;<br>SEQ. ID. NO. 14040 |
| CHIR210-i13 | AAGGTGTCCTTCGCCAACTTC;<br>SEQ. ID. NO. 14041 | GGUGUCCUUCGCCAACUUCtt;<br>SEQ. ID. NO. 14042 | GAAGUUGGCGAAGGACACCtt;<br>SEQ. ID. NO. 14043 |
| CHIR210-i14 | AACTTCATCCAGTACCTGCTG;<br>SEQ. ID. NO. 14044 | CUUCAUCCAGUACCUGCUGtt;<br>SEQ. ID. NO. 14045 | CAGCAGGUACUGGAUGAAGtt;<br>SEQ. ID. NO. 14046 |
| CHIR210-i15 | AAGCTGGAGACTCTGGACGAG;<br>SEQ. ID. NO. 14047 | GCUGGAGACUCUGGACGAGtt;<br>SEQ. ID. NO. 14048 | CUCGUCCAGAGUCUCCAGCtt;<br>SEQ. ID. NO. 14049 |
| CHIR210-i16 | AAACTCTACGAGGCCGACTTT;<br>SEQ. ID. NO. 14050 | ACUCUACGAGGCCGACUUUtt;<br>SEQ. ID. NO. 14051 | AAAGUCGGCCUCGUAGAGUtt;<br>SEQ. ID. NO. 14052 |
| CHIR210-i17 | AACCTCCTCCGAGACTGAAG;<br>SEQ. ID. NO. 14053 | CCUCCUCCGAGACUGAAGtt;<br>SEQ. ID. NO. 14054 | CUUUCAGUCUCGGAGGAGGtt;<br>SEQ. ID. NO. 14055 |

Fig. 27

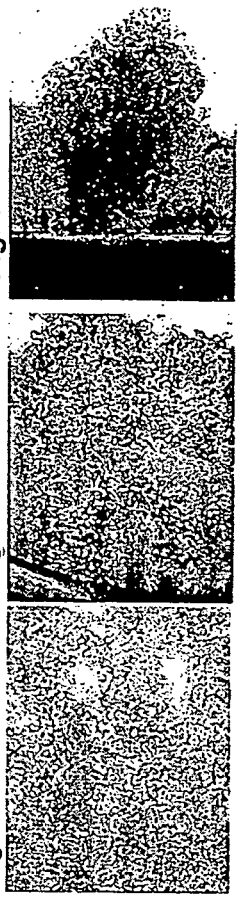
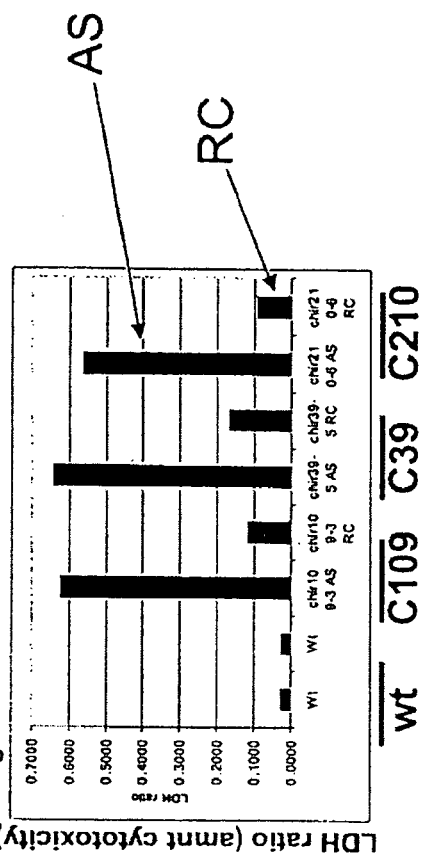
Figs. 32A-D

| Query | TrendHit | TrendsIn | OutOf | GBScore | QC | GBDesc | GBHit |
|---|---|---|---|---|---|---|---|
| 25837 | 3 cancers analyzed (colon breast prostate) | | | | | | |
| 25837 | 25837 | 3 | 3 | 3.00E-269 | internal | Homo sapiens, chondroitin 4-O-sulfotransferase 2, clone IMAGE: | BC015954 |
| 25837 | 33204 | 2 | 3 | 0 | verified | Human HLA-DMB mRNA, complete cds | U15085 |
| 25837 | 27721 | 2 | 3 | 1.00E-300 | internal | Homo sapiens mRNA for soluble guanylyl cyclase | Y15223 |
| 25837 | 20422 | 2 | 3 | 2.20E-195 | verified | Homo sapiens major histocompatibility complex, class II, DM bet | NM_00211 |
| 25837 | 31788 | 2 | 3 | 1.70E-264 | qc-assignt | Human HLA-DMB mRNA, complete cds | U15085 |
| 25837 | 12363 | 2 | 3 | 0 | verified | Human mRNA for type 1 inositol 1,4,5-trisphosphate receptor, c | D26070 |
| 25837 | 33563 | 2 | 3 | 0 | putative-o | Human HLA-DMB mRNA, complete cds | U15085 |
| All Hits: | http://evd/evd/ChEVDProcessIndiv.asp?SpotID=25837,33204,27721,20422,31788,12363,33563 | | | | | | |

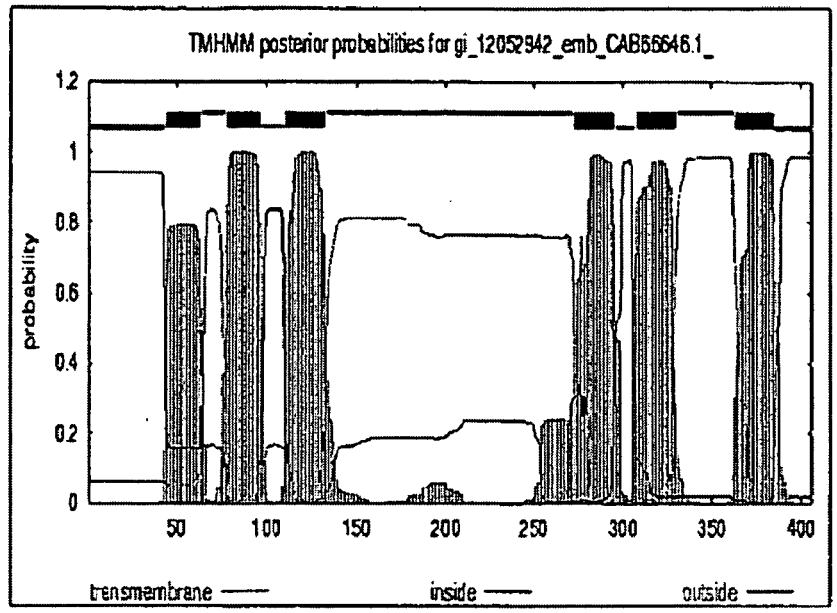

CBS Prediction Server for Transmembrane Proteins
gi_12052942_emb_CAB66646.1_ Length: 406
gi_12052942_emb_CAB66646.1_ Number of predicted TMHs: 6
gi_12052942_emb_CAB66646.1_ Exp number of AAs in TMHs: 132.21029
gi_12052942_emb_CAB66646.1_ Exp number, first 60 AAs: 13.48568
gi_12052942_emb_CAB66646.1_ Total prob of N-in: 0.94086
gi_12052942_emb_CAB66646.1_ POSSIBLE N-term signal sequence gi_12052942_emb_CAB66646.1_TMHMM2.0inside    1    43
gi_12052942_emb_CAB66646.1_TMHMM2.0TMhelix  44    63
gi_12052942_emb_CAB66646.1_TMHMM2.0outside  64    77
gi_12052942_emb_CAB66646.1_TMHMM2.0TMhelix  78    97
gi_12052942_emb_CAB66646.1_TMHMM2.0inside   98   109
gi_12052942_emb_CAB66646.1_TMHMM2.0TMhelix 110   132
gi_12052942_emb_CAB66646.1_TMHMM2.0outside 133   272
gi_12052942_emb_CAB66646.1_TMHMM2.0TMhelix 273   295
gi_12052942_emb_CAB66646.1_TMHMM2.0inside  296   307
gi_12052942_emb_CAB66646.1_TMHMM2.0TMhelix 308   330
gi_12052942_emb_CAB66646.1_TMHMM2.0outside 331   362
gi_12052942_emb_CAB66646.1_TMHMM2.0TMhelix 363   385
gi_12052942_emb_CAB66646.1_TMHMM2.0inside  386   406

FIG. 39

```
                              935                                   984
Seq. ID No. 14059    VMP1     (935)  TGGAATAACGTGTGGACACTTTCTGGTACCTTTTTGGACCTTCTTTGGTG
Seq. ID No. 14060    22793     (1)   -AGAATTTCAGCAGTTCTCTGATTTTTATATTTTATT-CCTCTTCCTATC
Seq. ID No. 14061    26883     (1)   ---TAGAAGAGCTAACCTCACACTCATCCCACTCTAAAC--TATGTGATT
Seq. ID No. 14062  Consensus  (935)       GAATAACAGCTG  CTCT ACT  TACCTTTTT  ACCTT T TGAT
                              985                                  1034
                     VMP1     (985)  CAA-CCCTAATTGGAAAAGCAATAATAAAAATGCATATCCAGAAAATTTT
                     22793    (49)   CAATCCCTGCCTTTTGAGTCCAGGTGGTAAGTACATTTTCTTTAACGTTT
                     26883    (46)   CAA-CACTGATTTTACATCCAACAAAGTGAAATCTTGATAGTTGGGTGTA
                   Consensus  (985)  CAA CCCTGATTTTA A  CAA AA GTAAAT CAT TTC TTAA TTTT
                              1035                                 1084
                     VMP1    1034)   TGTTATAATAACATTCAGCAAGCACA-TAGTG----GAGCAAATGGTGGC
                     22793    (99)   TTCCTGCTTTTCTTCCCAAATGTGTC-TTTTTCTTTGGGCTACTGTACCC
                     26883    (95)   AAAAGGAGAGTAATGGAGATTTCAGAGTAGTTGGGGTTGCTTACTTTTCA
                   Consensus (1035)  T   GA T TCAT CAGAATGCA A TAGTT    G GCTAATGTT CC
                              1085                                 1134
                     VMP1    (1079)  TTTCATTGGTGCTGTCCCCGGCATAGGTCCATCTCTGCAGAAGCCATTTC
                     22793   (148)   TGCTTCCAGTGCTGTCCCCGGCATAGGTCCATCTCTGCAGAAGCCATTTC
                     26883   (145)   TTT--TTAATTCTTTAGGTTTTGTAAGTTACACACTTCA--AGC-ATTAT
                   Consensus (1085)  TTT   TTAGTGCTGTCCCCGGCATAGGTCCATCTCTGCAGAAGCCATTTC
                              1135                                 1184
                     VMP1    (1129)  AGGAGTACCTGGAGGCTCAACGGCA-----GAAGC-TTCACCACAAAAGC
                     22793   (198)   AGGAGTACCTGGAGGCTCAACGGCA-----GAAGC-TTCACCACAAAAGC
                     26883   (190)   AGATGATCCTCTTTTTACTAGTGAACTAATGAAGCCTTTTTCATTGCATT
                   Consensus (1135)  AGGAGTACCTGGAGGCTCAACGGCA     GAAGC TTCACCACAAAAGC
                              1185                                 1234
                     VMP1    (1173)  GAAATGGGCACA---CCACAGGGAGAAAACTGGTTGTCCTGGATGTTTGA
                     22793   (242)   GAAATGGGCACA---CCACAGGGAGAAAACTGCTTGTCCTGGATGTTTGA
                     26883   (240)   GTTCTGCATTTATTTCTACAGGGAGAAAACTGGTTGTCCTGGATGTTTGA
                   Consensus (1185)  GAAATGGGCACA   CCACAGGGAGAAAACTGGTTGTCCTGGATGTTTGA
                              1235                                 1284
                     VMP1    (1220)  AAAGTTGGTCGTTGTCATGGTGTGTTAGTTCATCCTATCTATCATTAACT
                     22793   (289)   AAAGTCGGTCGATGTCATGGTGTGTTACTTCATCCTATCTATCATTAACT
                     26883   (290)   AAAGTTGGTCGTTGTCATGGTGTGTTACTTCATCCTATCTATCATTAACT
                   Consensus (1235)  AAAGTTGGTCGTTGTCATGGTGTGTTACTTCATCCTATCTATCATTAACT
                              1285                                 1334
                     VMP1    (1270)  CCATGGCACAAAGTTATGCCAAACGAATCCAGCAGCGGTTGAACTCAGAG
                     22793   (339)   CCATGGCACAAAGTTATGCCAAACGAATCCAGCAGCGGTTGAACTCAGAG
                     26883   (340)   CCATGGCACAAAGTTATGCCAAACGAATCGAGCAG---------------
                   Consensus (1285)  CCATGGCACAAAGTTATGCCAAACGAATCCAGCAGCGGTTGAACTCAGAG
                              1335                                 1384
                     VMP1    (1320)  GAGAAAACTAAATAAGTAGAGAAAGTTTTAAACTGCAGAAATTGGAGTGG
                     22793   (389)   GAGAAAACTAAATAAGTAGAGAAAGTTTTAAACTGCAGAAATTGGAGTGG
                     26883   (375)   --------------------------------------------------
                   Consensus (1335)  GAGAAAACTAAATAAGTAGAGAAAGTTTTAAACTGCAGAAATTGGAGTGG
                              1385                                 1434
                     VMP1    1370)   ATGGGTTCTGCCTTAAATTGGGAGGACTCCAAGCCGGGAAGGAAAATTCC
                     22793   (439)   ATGGGTTCTGCCTTATATTGGGAGGACTCCAAGCCGGGAAGGAAAATTCC
                     26883   (375)   --------------------------------------------------
                   Consensus (1385)  ATGGGTTCTGCCTTA ATTGGGAGGACTCCAAGCCGGGAAGGAAAATTCC
                              1435                1467
                     VMP1    (1420)  CTTTTCCAACCTGTATCAATTTTTACAACTTTT
                     22793   (489)   CTTTT----------------------------
                     26883   (375)   ---------------------------------
                   Consensus (1435)  CTTTT
```

FIG. 41

Spot 22793 mapped to VMP1

Seq. ID No. 14063   VMP1:  1087  gtgctgtccccggcataggtccatctctgcagaagccatttcaggagtacctggaggctc 1146
                                 ||||||||||||||||||||||||||||||||||||||||||||||||||||||||||||
Seq. ID No. 14064   22793: 156   gtgctgtccccggcataggtccatctctgcagaagccatttcaggagtacctggaggctc 215

VMP1:  1147  aacggcagaagcttcaccacaaaagcgaaatgggcacaccacagggagaaaactggttgt 1206
                                 |||||||||||||||||||||||||||||||||||||||||||||||||||||||| ||||
                    22793: 216   aacggcagaagcttcaccacaaaagcgaaatgggcacaccacagggagaaaactgcttgt 275

VMP1:  1207  cctggatgtttgaaaagttggtcgttgtcatggtgtgttacttcatcctatctatcatta 1266
                                 |||||||||||||| |||| |||||||||||||||||||||||||||||||||||||||
                    22793: 276   cctggatgtttgaaaagtcggtcgatgtcatggtgtgttacttcatcctatctatcatta 335

VMP1:  1267  actccatggcacaaagttatgccaaacgaatccagcagcggttgaactcagaggagaaaa 1326
                                 ||||||||||||||||||||||||||||||||||||||||||||||||||||||||||||
                    22793: 336   actccatggcacaaagttatgccaaacgaatccagcagcggttgaactcagaggagaaaa 395

VMP1:  1327  ctaaataagtagagaaagttttaaactgcagaaattggagtggatgggttctgccttaaa 1386
                                 ||||||||||||||||||||||||||||||||||||||||||||||||||||||||||  |
                    22793: 396   ctaaataagtagagaaagttttaaactgcagaaattggagtggatgggttctgccttata 455

VMP1:  1387  ttgggaggactccaagccgggaaggaaaattcccttt 1424
                                 |||||||||||||||||||||||||||||||||||||
                    22793: 456   ttgggaggactccaagccgggaaggaaaattcccttt 493

Spot 27450 mapped to VMP1

Seq. ID No. 14065   VMP1:  2330  tgtgttaatgtttctagcatgtactctggtttcaacagacacaaatttatatgttaacc 2389
                                 |||||||||||||||||||||||||||||||||||||||||||||||||||||||||||
Seq. ID No. 14065   27450: 1     tgtgttaatgtttctagcatgtactctggtttcaacagacacaaatttatatgttaacc 60

VMP1:  2390  cagttttcttgccgttctgtaagtgtttattcttagtgtgattttttttccattgggatg 2449
                                 ||||||||||||||||||||||||||||||||||||||||||||||||||||||||||||
                    27450: 61    cagttttcttgccgttctgtaagtgtttattcttagtgtgattttttttccattgggatg 120

VMP1:  2450  tttttgattgaacttgttcatttttgtttgcttggggaggaaaataaacaattttactttt 2509
                                 ||||||||||||||||||||||||||||||||||||||||||||||||||||||||||||
                    27450: 121   tttttgattgaacttgttcatttttgtttgcttggggaggaaaataaacaattttactttt 180

VMP1:  2510  ttcctt 2515
                                 ||||||
                    27450: 181   ttcctt 186

Spot 26883 mapped to VMP1

Seq. ID No. 14066   VMP1:  1187  acagggagaaaactggttgtcctggatgtttgaaaagttggtcgttgtcatggtgtgtta 1246
                                 ||||||||||||||||||||||||||||||||||||||||||||||||||||||||||||
Seq. ID No. 14066   26883: 257   acagggagaaaactggttgtcctggatgtttgaaaagttggtcgttgtcatggtgtgtta 316

VMP1:  1247  cttcatcctatctatcattaactccatggcacaaagttatgccaaacgaatccagcag 1304
                                 ||||||||||||||||||||||||||||||||||||||||||||||||||||||||||
                    26883: 317   cttcatcctatctatcattaactccatggcacaaagttatgccaaacgaatccagcag 374

FIG. 42

GENE PRODUCTS DIFFERENTIALLY EXPRESSED IN CANCEROUS CELLS

CROSS-REFERENCE TO RELATED APPLICATIONS

This application is continuation-in-part of and claims priority to U.S. application Ser. No. 10/616,900, filed on Jul. 9, 2003, now abandoned which is a continuation of U.S. application Ser. No. 09/872,850, filed on Jun. 1, 2001, now abandoned, which claims the benefit of U.S. provisional application Ser. No. 60/208,871, filed on Jun. 2, 2000. This application is also a continuation-in-part of and claims priority to U.S. application Ser. No. 10/081,519, filed on Feb. 21, 2002, now abandoned, which claims the benefit of U.S. provisional application Ser. No. 60/270,959, filed on Feb. 21, 2001. This application is also a continuation-in-part of and claims priority to U.S. application Ser. No. 10/310,673, filed on Dec. 4, 2002, now abandoned, which claims the benefit of U.S. provisional application Ser. No. 60/336,613, filed on Dec. 4, 2001. This application is also a continuation-in-part of and claims priority to U.S. application Ser. No. 10/501,187, filed as a 371 of international application No. PCT/US03/00657, filed on Jan. 8, 2003, which claims the benefit of U.S. provisional application Ser. No. 60/345,637, filed on Jan. 8, 2002. This application is also a continuation-in-part of and claims priority to U.S. application Ser. No. 10/081,124, filed on Feb. 21, 2002, now abandoned, which claims the benefit of U.S. provisional application Ser. No. 60/270,855, filed on Feb. 21, 2001. This application is also a continuation-in-part of and claims priority to application PCT/US04/15421, filed on May 13, 2004, which claims the benefit of U.S. provisional application Ser. No. 60/475,872, filed on Jun. 3, 2003. The contents of each of the preceding applications is incorporated by reference in its entirety.

SEQUENCE LISTING AND TABLES

A Sequence Listing is provided as part of this specification on triplicate compact discs, filed concurrently herewith, which compact discs named "Copy 1", "Copy 2", and "CRF" each of which compact discs contain the following file: "SEQLIST.TXT", created Sep. 7, 2004, of 8693 kilobytes, which is incorporated herein by reference in its entirety.

The present application also incorporates by reference Tables 6, 15, 16, 31, 33, 34, and 35 contained on duplicate compact discs filed concurrently herewith, which compact discs are labeled "Tables Copy 1" and "Tables Copy 2". The details of these Tables are further described later in this disclosure. These compact discs were created on Sep. 7th, 2004. The sizes of the Tables are as follows: Table 6: 70 kilobytes; Table 15: 254 kilobytes; Table 16: 407 kilobytes; Table 31: 603 kilobytes; Table 33: 379 kilobytes; Table 34: 985 kilobytes; and Table 35: 518 kilobytes.

FIELD OF THE INVENTION

The present invention relates to polynucleotides of human origin in substantially isolated form and gene products that are differentially expressed in cancer cells, and uses thereof.

BACKGROUND OF THE INVENTION

Cancer, like many diseases, is not the result of a single, well-defined cause, but rather can be viewed as several diseases, each caused by different aberrations in informational pathways, that ultimately result in apparently similar pathologic phenotypes. Identification of polynucleotides that correspond to genes that are differentially expressed in cancerous, pre-cancerous, or low metastatic potential cells relative to normal cells of the same tissue type, provides the basis for diagnostic tools, facilitates drug discovery by providing for targets for candidate agents, and further serves to identify therapeutic targets for cancer therapies that are more tailored for the type of cancer to be treated.

Identification of differentially expressed gene products also furthers the understanding of the progression and nature of complex diseases such as cancer, and is key to identifying the genetic factors that are responsible for the phenotypes associated with development of, for example, the metastatic phenotype. Identification of gene products that are differentially expressed at various stages, and in various types of cancers, can both provide for early diagnostic tests, and further serve as therapeutic targets. Additionally, the product of a differentially expressed gene can be the basis for screening assays to identify chemotherapeutic agents that modulate its activity (e.g. its expression, biological activity, and the like).

Early disease diagnosis is of central importance to halting disease progression, and reducing morbidity. Analysis of a patient's tumor to identify the gene products that are differentially expressed, and administration of therapeutic agent(s) designed to modulate the activity of those differentially expressed gene products, provides the basis for more specific, rational cancer therapy that may result in diminished adverse side effects relative to conventional therapies. Furthermore, confirmation that a tumor poses less risk to the patient (e.g., that the tumor is benign) can avoid unnecessary therapies. In short, identification of genes and the encoded gene products that are differentially expressed in cancerous cells can provide the basis of therapeutics, diagnostics, prognostics, therametrics, and the like.

For example, breast cancer is a leading cause of death among women. One of the priorities in breast cancer research is the discovery of new biochemical markers that can be used for diagnosis, prognosis and monitoring of breast cancer. The prognostic usefulness of these markers depends on the ability of the marker to distinguish between patients with breast cancer who require aggressive therapeutic treatment and patients who should be monitored.

LENGTHY TABLES

The patent contains a lengthy table section. A copy of the table is available in electronic form from the USPTO web site (http://seqdata.uspto.gov/?pageRequest=docDetail&DocID=US07700359B2). An electronic copy of the table will also be available from the USPTO upon request and payment of the fee set forth in 37 CFR 1.19(b)(3).

While the pathogenesis of breast cancer is unclear, transformation of non-tumorigenic breast epithelium to a malignant phenotype may be the result of genetic factors, especially in women under 30 (Miki, et al., Science, 266: 66-71, 1994). However, it is likely that other, non-genetic factors are also significant in the etiology of the disease. Regardless of its origin, breast cancer morbidity increases significantly if a lesion is not detected early in its progression. Thus, considerable effort has focused on the elucidation of early cellular events surrounding transformation in breast tissue. Such effort has led to the identification of several potential breast cancer markers.

Thus, the identification of new markers associated with cancer, for example, breast cancer, and the identification of genes involved in transforming cells into the cancerous phenotype, remains a significant goal in the management of this disease. In exemplary aspects, the invention described herein provides cancer diagnostics, prognostics, therametrics, and therapeutics based upon polynucleotides and/or their encoded gene products.

SUMMARY OF THE INVENTION

The present invention provides methods and compositions useful in detection of cancerous cells, identification of agents that modulate the phenotype of cancerous cells, and identification of therapeutic targets for chemotherapy of cancerous cells. Cancerous prostate cells are of particular interest in each of these aspects of the invention. More specifically, the invention provides polynucleotides, as well as polypeptides encoded thereby, that are differentially expressed in prostate cancer cells. Also provided are antibodies that specifically bind the encoded polypeptides. These polynucleotides, polypeptides and antibodies are thus useful in a variety of diagnostic, therapeutic, and drug discovery methods. In some embodiments, a polynucleotide that is differentially expressed in prostate cancer cells can be used in diagnostic assays to detect prostate cancer cells. In other embodiments, a polynucleotide that is differentially expressed in prostate cancer cells, and/or a polypeptide encoded thereby, is itself a target for therapeutic intervention.

Accordingly, in one aspect the invention provides a method for detecting a cancerous prostate cell. In general, the method involves contacting a test sample obtained from a cell that is suspected of being a prostate cancer cell with a probe for detecting a gene product differentially expressed in prostate cancer. Many embodiments of the invention involve a gene identifiable or comprising a sequence selected from the group consisting of SEQ ID NOS: 1-13996, contacting the probe and the gene product for a time sufficient for binding of the probe to the gene product; and comparing a level of binding of the probe to the sample with a level of probe binding to a control sample obtained from a control prostate cell of known cancerous state. A modulated (i.e. increased or decreased) level of binding of the probe in the test prostate cell sample relative to the level of binding in a control sample is indicative of the cancerous state of the test prostate cell. In certain embodiments, the level of binding of the probe in the test cell sample, usually in relation to at least one control gene, is similar to binding of the probe to a cancerous cell sample. In certain other embodiments, the level of binding of the probe in the test cell sample, usually in relation to at least one control gene, is different, i.e. opposite, to binding of the probe to a non-cancerous cell sample. In specific embodiments, the probe is a polynucleotide probe and the gene product is nucleic acid. In other specific embodiments, the gene product is a polypeptide. In further embodiments, the gene product or the probe is immobilized on an array.

In another aspect, the invention provides a method for assessing the cancerous phenotype (e.g., metastasis, metastatic potential, aberrant cellular proliferation, and the like) of a prostate cell comprising detecting expression of a gene product in a test prostate cell sample, wherein the gene comprises a sequence selected from the group consisting of SEQ ID NOS: 1-13996; and comparing a level of expression of the gene product in the test prostate cell sample with a level of expression of the gene in a control cell sample. Comparison of the level of expression of the gene in the test cell sample relative to the level of expression in the control cell sample is indicative of the cancerous phenotype of the test cell sample. In specific embodiments, detection of gene expression is by detecting a level of an RNA transcript in the test cell sample. In other specific embodiments detection of expression of the gene is by detecting a level of a polypeptide in a test sample.

In another aspect, the invention provides a method for suppressing or inhibiting a cancerous phenotype of a cancerous cell, the method comprising introducing into a mammalian cell an expression modulatory agent (e.g. an antisense molecule, small molecule, antibody, neutralizing antibody, inhibitory RNA molecule, etc.) to inhibition of expression of a gene identified by a sequence selected from the group consisting of SEQ ID NOS: 1-13996. Inhibition of expression of the gene inhibits development of a cancerous phenotype in the cell. In specific embodiments, the cancerous phenotype is metastasis, aberrant cellular proliferation relative to a normal cell, or loss of contact inhibition of cell growth. In the context of this invention "expression" of a gene is intended to encompass the expression of an activity of a gene product, and, as such, inhibiting expression of a gene includes inhibiting the activity of a product of the gene.

In another aspect, the invention provides a method for assessing the tumor burden of a subject, the method comprising detecting a level of a differentially expressed gene product in a test sample from a subject suspected of or having a tumor, the differentially expressed gene product comprising a sequence selected from the group consisting of SEQ ID NOS: 1-13996. Detection of the level of the gene product in the test sample is indicative of the tumor burden in the subject.

In another aspect, the invention provides a method for identifying a gene product as a target for a cancer therapeutic, the method comprising contacting a cancerous cell expressing a candidate gene product with an anti-cancer agent, wherein the candidate gene product corresponds to a sequence selected from the group consisting of SEQ ID NOS: 1-13996; and analyzing the effect of the anti-cancer agent upon a biological activity of the candidate gene product and/or upon a cancerous phenotype of the cancerous cell. Modulation of the biological activity of the candidate gene product and modulation of the cancerous phenotype of the cancerous cell indicates the candidate gene product is a target for a cancer therapeutic. In specific embodiments, the cancerous cell is a cancerous prostate cell. In other specific embodiments, the inhibitor is an antisense oligonucleotide. In further embodiments, the cancerous phenotype is aberrant cellular proliferation relative to a normal cell, or colony formation due to loss of contact inhibition of cell growth.

In another aspect, the invention provides a method for identifying agents that modulate (i.e. increase or decrease) the biological activity of a gene product differentially expressed in a cancerous cell, the method comprising contacting a candidate agent with a differentially expressed gene product, the differentially expressed gene product corresponding to a sequence selected from the group consisting of SEQ ID NOS: 1-13996; and detecting a modulation in a biological activity of the gene product relative to a level of biological activity of the gene product in the absence of the candidate agent. In specific embodiments, the detecting is by identifying an increase or decrease in expression of the differentially expressed gene product. In other specific embodiments, the gene product is mRNA or cDNA prepared from the mRNA gene product. In further embodiments, the gene product is a polypeptide.

In another aspect, the invention provides a method of inhibiting growth of a tumor cell by modulating expression of a gene product, where the gene product is encoded by a gene identified by a sequence selected from the group consisting of: SEQ ID NOS:1-13996.

The invention provides a method of determining the cancerous state of a cell, comprising detecting a level of a product of a gene in a test cell wherein said gene is defined by a sequence selected from a group consisting of SEQ ID NOS: 1-13996 wherein the cancerous state of the test cell is indicated by detection of said level and comparison to a control level of said gene product. In certain embodiments of this method, the gene product is a nucleic acid or a polypeptide. In certain embodiments of this method, the gene product is immobilized on an array. In one embodiment of this method, the control level is a level of said gene product associated with a control cell of known cancerous state. In other embodiments of this method, the known cancerous state is a non-cancerous state. In another embodiment of this method, the level differs from the control level by at least two fold, indicating the test cell is not of the same cancerous state as that indicated by the control level.

BRIEF DESCRIPTION OF THE FIGURES

FIGS. 2-17 are graphs showing the expression profiles of the genes of Group 1.

FIG. 22 is a table showing the expression of condroitin 4-O sulfotransferase 2 (C4S-2) in cancer versus normal cells, as determined by microarray analysis.

FIG. 26 is a table of antisense polynucleotides, directed against C4S-2.

FIG. 27 is a table of inhibitory RNA polynucleotides, directed against C4S-2.

FIGS. 32A-D show the effects of C4S-2 antisense molecules on MDA PCa 2b spheroids. FIGS. 32A-C are photographs of spheroids. FIG. 32D is a bar graph showing LDH ratios.

FIG. 33A is a graph of cytotoxicity. FIG. 33B is a graph showing relative mRNA expression of C4S-2 in cell lines. FIG. 33C is a panel of photographs of MRC9 cells.

FIG. 36 is a table of genes that are co-regulated with C4S-2.

FIG. 37 is a sequence alignment of mouse C4S-2 (top) and human C4S-2 (bottom).

FIG. 39 is a graph of a hydropathy plot and a table showing the hydrophobic regions of DKFZp566I133.

FIG. 41 is an alignment of spot ID 22793 and spot ID 26883.

FIG. 42 is a figure of three sequence alignments showing the mapping of each of three sequences onto VMP1 (DKFZ).

DETAILED DESCRIPTION OF THE INVENTION

Figure 1:
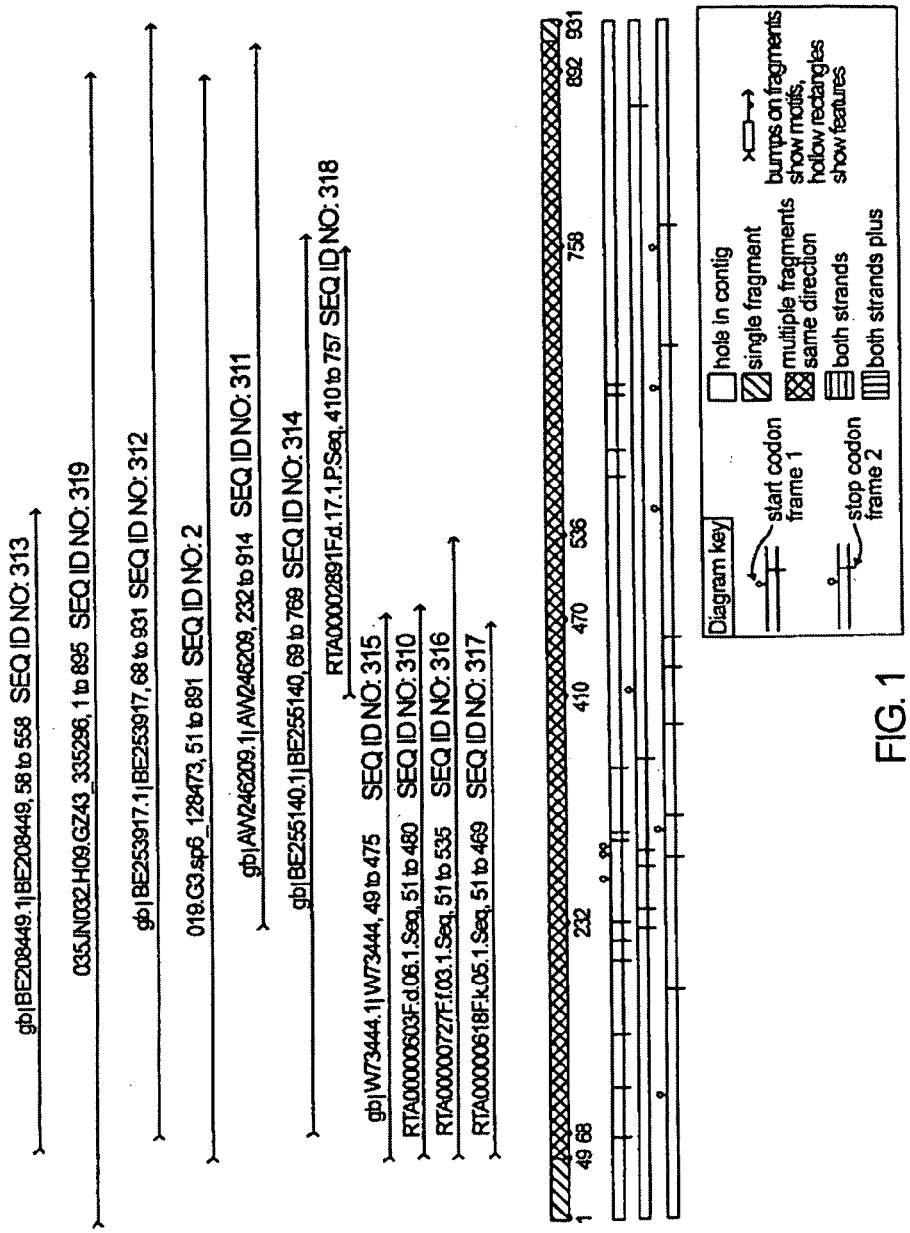
FIG. 1 is a schematic showing the alignment of the sequences (represented by single lines) that resulted in the assembly of the contig (represented by the bars in the lower portion of the figure).
Figures 2, 3, 4, 5:
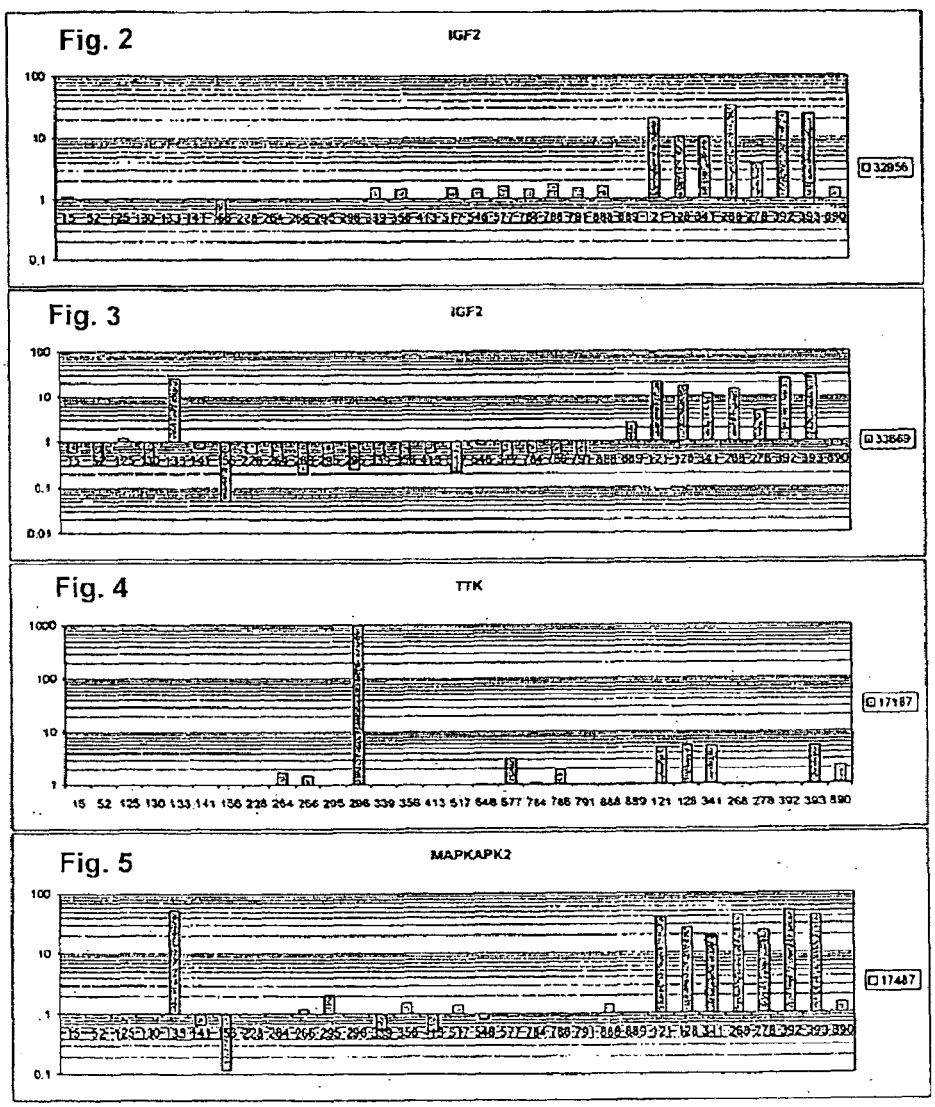
Figures 10, 11, 12, 13:
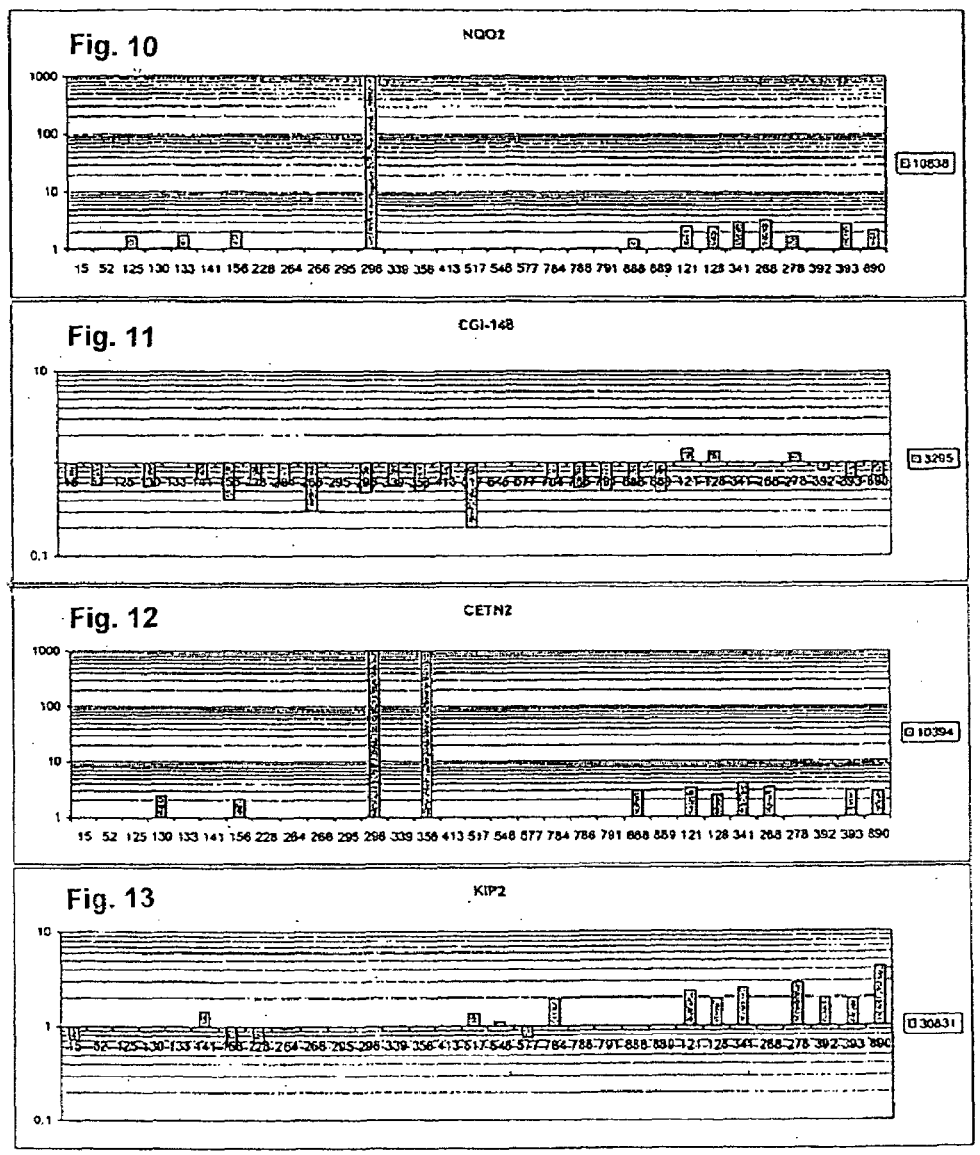
Figures 14, 15, 16, 17:
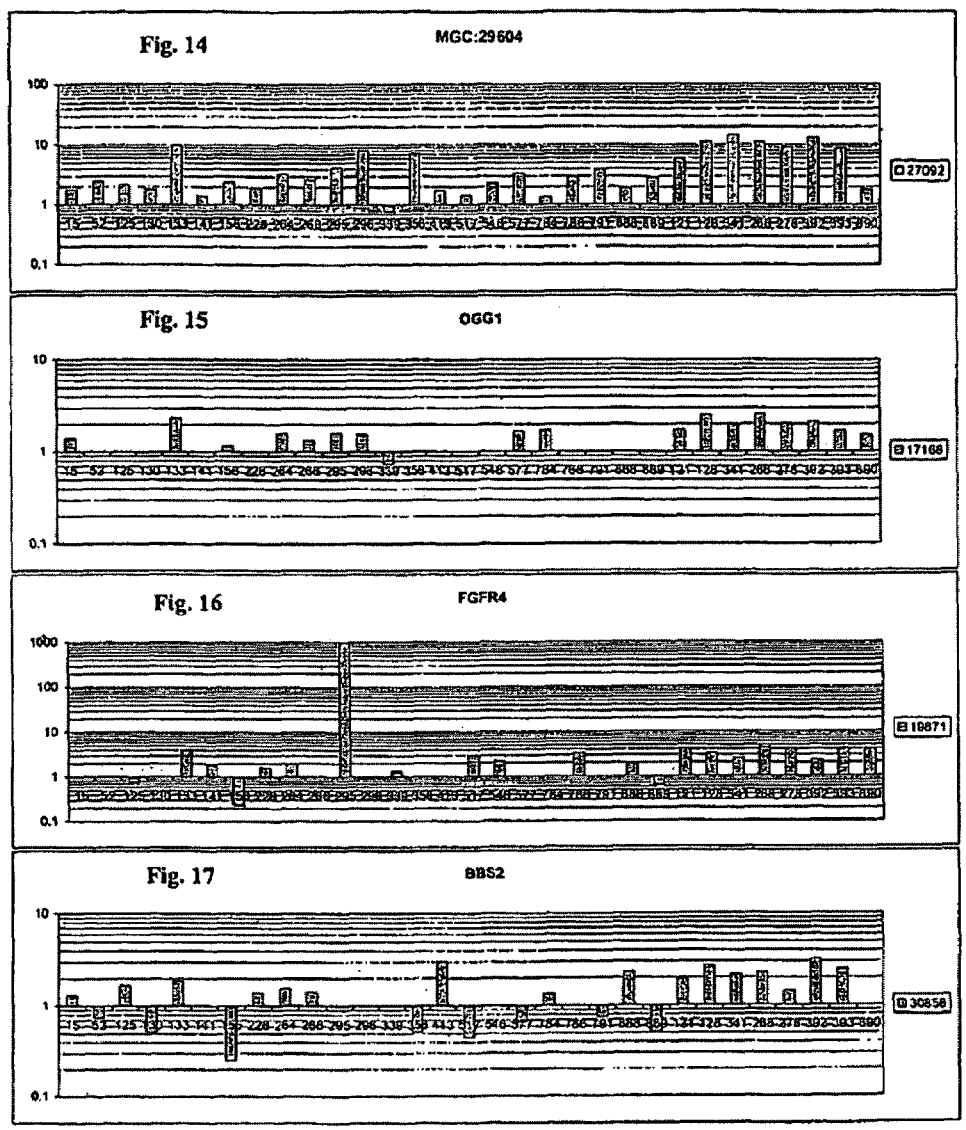
Figures 18, 19, 20, 21:
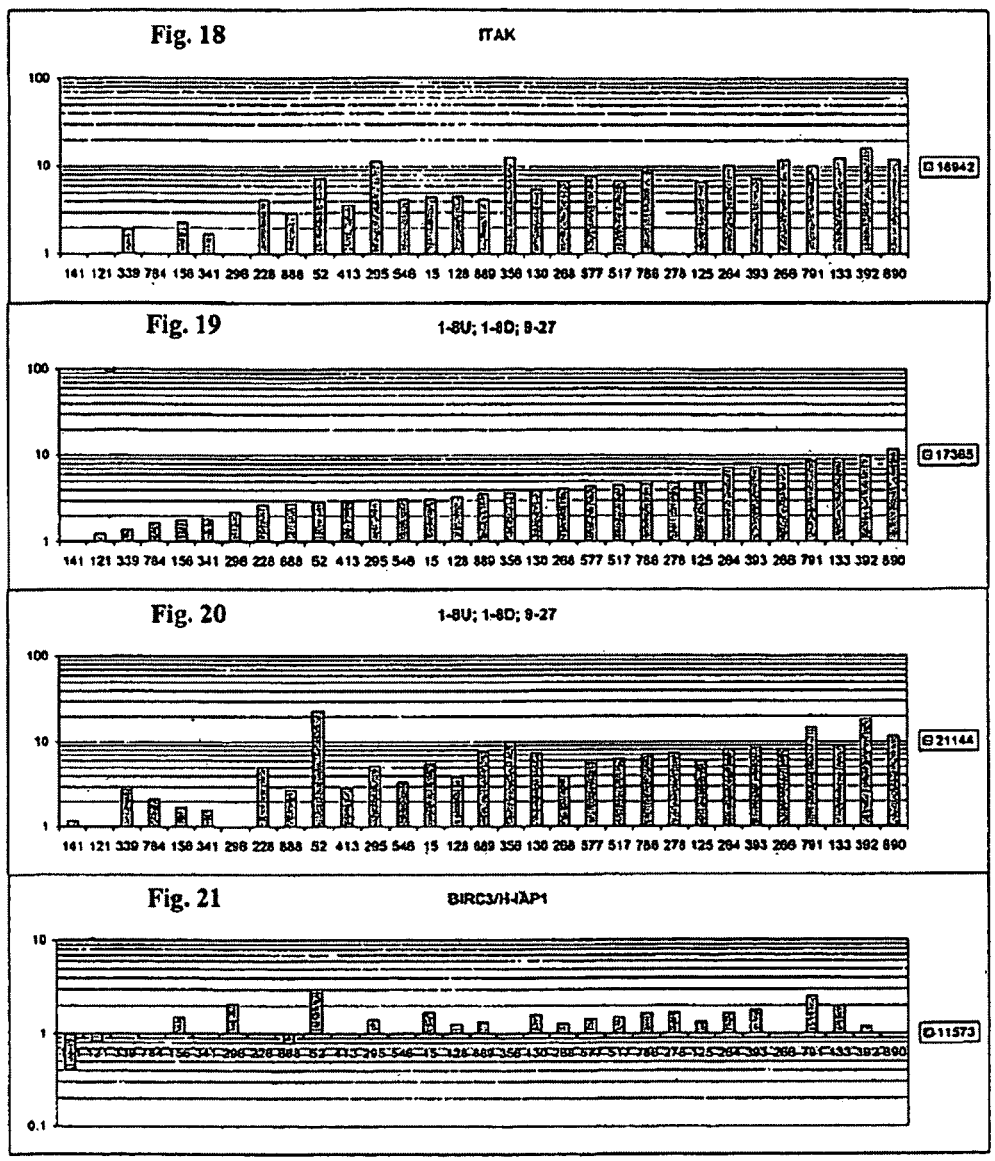
FIGS. 18-21 are graphs showing the expression profiles of the genes of Group 2. In addition to the figures described above, the application also includes Tables 10-12, as well as a Sequence Listing.

The present invention provides polynucleotides, as well as polypeptides encoded thereby, that are differentially expressed in cancer cells. Methods are provided in which these polynucleotides and polypeptides are used for detecting and reducing the growth of cancer cells. Also provided are methods in which the polynucleotides and polypeptides of the invention are used in a variety of diagnostic and therapeutic applications for cancer. The invention finds use in the prevention, treatment, detection or research into any cancer, including prostrate, pancreas, colon, brain, lung, breast, bone, skin cancers. For example, the invention finds use in the prevention, treatment, detection of or research into endocrine system cancers, such as cancers of the thyroid, pituitary, and adrenal glands and the pancreatic islets; gastrointestinal cancers, such as cancer of the anus, colon, esophagus, gallbladder, stomach, liver, and rectum; genitourinary cancers such as cancer of the penis, prostate and testes; gynecological cancers, such as cancer of the ovaries, cervix, endometrium, uterus, fallopian tubes, vagina, and vulva; head and neck cancers, such as hypopharyngeal, laryngeal, oropharyngeal cancers, lip, mouth and oral cancers, cancer of the salivary gland, cancer of the digestive tract and sinus cancer; leukemia; lymphomas including Hodgkin's and non-Hodgkin's lymphoma; metastatic cancer; myelomas; sarcomas; skin cancer; urinary tract cancers including bladder, kidney and urethral cancers; and pediatric cancers, such as pediatric brain tumors, leukemia, lymphomas, sarcomas, liver cancer and neuroblastoma and retinoblastoma.

Before the present invention is described, it is to be understood that this invention is not limited to particular embodiments described, as such may, of course, vary. It is also to be understood that the terminology used herein is for the purpose of describing particular embodiments only, and is not intended to be limiting.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, the preferred methods and materials are now described. All publications and patent applications mentioned herein are incorporated herein by reference to disclose and describe the methods and/or materials in connection with which the publications are cited.

It must be noted that as used herein and in the appended claims, the singular forms "a", "and", and "the" include plural referents unless the context clearly dictates otherwise. Thus, for example, reference to "a polynucleotide" includes a plurality of such polynucleotides and reference to "the cancer cell" includes reference to one or more cells and equivalents thereof known to those skilled in the art, and so forth.

The publications and applications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DEFINITIONS

The terms "polynucleotide" and "nucleic acid", used interchangeably herein, refer to polymeric forms of nucleotides of any length, either ribonucleotides or deoxynucleotides. Thus, these terms include, but are not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. These terms further include, but are not limited to, mRNA or cDNA that comprise intronic sequences (see, e.g., Niwa et al. (1999) *Cell* 99(7):691-702). The backbone of the polynucleotide can comprise sugars and phosphate groups (as may typically be found in RNA or DNA), or modified or substituted sugar or phosphate groups. Alternatively, the backbone of the polynucleotide can comprise a polymer of synthetic subunits such as phosphoramidites and thus can be an oligodeoxynucleoside phosphoramidate or a mixed phosphoramidate-phosphodiester oligomer. Peyrottes et al. (1996) *Nucl. Acids Res.* 24:1841-1848; Chaturvedi et al. (1996) *Nucl. Acids Res.* 24:2318-2323. A polynucleotide may comprise modified nucleotides, such as methylated nucleotides and nucleotide analogs, uracyl, other sugars, and linking groups such as fluororibose and thioate, and nucleotide branches. The sequence of nucleotides may be interrupted by non-nucleotide components. A polynucleotide may be further modified after polymerization, such as by conjugation with a labeling component. Other types of modifications included in this definition are caps, substitution of one or more of the naturally occurring nucleotides with an analog, and introduction of means for attaching the polynucleotide to proteins, metal ions, labeling components, other polynucleotides, or a solid support. The term "polynucleotide" also encompasses peptidic nucleic acids (Pooga et al *Curr Cancer Drug Targets.* (2001) 1:231-9).

A "gene product" is a biopolymeric product that is expressed or produced by a gene. A gene product may be, for example, an unspliced RNA, an mRNA, a splice variant mRNA, a polypeptide, a post-translationally modified polypeptide, a splice variant polypeptide etc. Also encompassed by this term is biopolymeric products that are made using an RNA gene product as a template (i.e. cDNA of the RNA). A gene product may be made enzymatically, recombinantly, chemically, or within a cell to which the gene is native. In many embodiments, if the gene product is proteinaceous, it exhibits a biological activity. In many embodiments, if the gene product is a nucleic acid, it can be translated into a proteinaceous gene product that exhibits a biological activity.

A composition (e.g. a polynucleotide, polypeptide, antibody, or host cell) that is "isolated" or "in substantially isolated form" refers to a composition that is in an environment different from that in which the composition naturally occurs. For example, a polynucleotide that is in substantially isolated form is outside of the host cell in which the polynucleotide naturally occurs, and could be a purified fragment of DNA, could be part of a heterologous vector, or could be contained within a host cell that is not a host cell from which the polynucleotide naturally occurs. The term "isolated" does not refer to a genomic or cDNA library, whole cell total protein or mRNA preparation, genomic DNA preparation, or an isolated human chromosome. A composition which is in substantially isolated form is usually substantially purified.

As used herein, the term "substantially purified" refers to a compound (e.g., a polynucleotide, a polypeptide or an antibody, etc.) that is removed from its natural environment and is usually at least 60% free, preferably 75% free, and most preferably 90% free from other components with which it is naturally associated. Thus, for example, a composition containing A is "substantially free of" B when at least 85% by weight of the total A+B in the composition is A. Preferably, A comprises at least about 90% by weight of the total of A+B in the composition, more preferably at least about 95% or even 99% by weight. In the case of polynucleotides, "A" and "B" may be two different genes positioned on different chromosomes or adjacently on the same chromosome, or two isolated cDNA species, for example.

The terms "polypeptide" and "protein", interchangeably used herein, refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

"Heterologous" refers to materials that are derived from different sources (e.g., from different genes, different species, etc.).

As used herein, the terms "a gene that is differentially expressed in a cancer cell," and "a polynucleotide that is differentially expressed in a cancer cell" are used interchangeably herein, and generally refer to a polynucleotide that represents or corresponds to a gene that is differentially expressed in a cancerous cell when compared with a cell of the same cell type that is not cancerous, e.g., mRNA is found at levels at least about 25%, at least about 50% to about 75%, at least about 90%, at least about 1.5-fold, at least about 2-fold, at least about 5-fold, at least about 10-fold, or at least about 50-fold or more, different (e.g., higher or lower). The comparison can be made in tissue, for example, if one is using in situ hybridization or another assay method that allows some degree of discrimination among cell types in the tissue. The comparison may also or alternatively be made between cells removed from their tissue source.

"Differentially expressed polynucleotide" as used herein refers to a nucleic acid molecule (RNA or DNA) comprising a sequence that represents a differentially expressed gene, e.g., the differentially expressed polynucleotide comprises a sequence (e.g., an open reading frame encoding a gene product; a non-coding sequence) that uniquely identifies a differentially expressed gene so that detection of the differentially expressed polynucleotide in a sample is correlated with the presence of a differentially expressed gene in a sample. "Differentially expressed polynucleotides" is also meant to encompass fragments of the disclosed polynucleotides, e.g., fragments retaining biological activity, as well as nucleic acids homologous, substantially similar, or substantially identical (e.g., having about 90% sequence identity) to the disclosed polynucleotides.

"Corresponds to" or "represents" when used in the context of, for example, a polynucleotide or sequence that "corresponds to" or "represents" a gene means that at least a portion of a sequence of the polynucleotide is present in the gene or in the nucleic acid gene product (e.g., mRNA or cDNA). A subject nucleic acid may also be "identified" by a polynucleotide if the polynucleotide corresponds to or represents the gene. Genes identified by a polynucleotide may have all or a portion of the identifying sequence wholly present within an exon of a genomic sequence of the gene, or different portions of the sequence of the polynucleotide may be present in different exons (e.g., such that the contiguous polynucleotide sequence is present in an mRNA, either pre- or post-splicing, that is an expression product of the gene). In some embodiments, the polynucleotide may represent or correspond to a gene that is modified in a cancerous cell relative to a normal cell. The gene in the cancerous cell may contain a deletion, insertion, substitution, or translocation relative to the polynucleotide and may have altered regulatory sequences, or may encode a splice variant gene product, for example. The gene in the cancerous cell may be modified by insertion of an endogenous retrovirus, a transposable element, or other naturally occurring or non-naturally occurring nucleic acid. In most cases, a polynucleotide corresponds to or represents a gene if the sequence of the polynucleotide is most identical to the sequence of a gene or its product (e.g. mRNA or cDNA) as compared to other genes or their products. In most embodiments, the most identical gene is determined using a sequence comparison of a polynucleotide to a database of polynucleotides (e.g. GenBank) using the BLAST program at default settings For example, if the most similar gene in the human genome to an exemplary polynucleotide is the protein kinase C gene, the exemplary polynucleotide corresponds to protein kinase C. In most cases, the sequence of a fragment of an exemplary polynucleotide is at least 95%, 96%, 97%, 98%, 99% or up to 100% identical to a sequence of at least 15, 20, 25, 30, 35, 40, 45, or 50 contiguous nucleotides of a corresponding gene or its product (mRNA or cDNA), when nucleotides that are "N" represent G, A, T or C.

An "identifying sequence" is a minimal fragment of a sequence of contiguous nucleotides that uniquely identifies or defines a polynucleotide sequence or its complement. In many embodiments, a fragment of a polynucleotide uniquely identifies or defines a polynucleotide sequence or its complement. In some embodiments, the entire contiguous sequence of a gene, cDNA, EST, or other provided sequence is an identifying sequence.

"Diagnosis" as used herein generally includes determination of a subject's susceptibility to a disease or disorder, determination as to whether a subject is presently affected by a disease or disorder, prognosis of a subject affected by a disease or disorder (e.g., identification of pre-metastatic or metastatic cancerous states, stages of cancer, or responsiveness of cancer to therapy), and use of therametrics (e.g., monitoring a subject's condition to provide information as to the effect or efficacy of therapy).

As used herein, the term "a polypeptide associated with cancer" refers to a polypeptide encoded by a polynucleotide that is differentially expressed in a cancer cell.

The term "biological sample" encompasses a variety of sample types obtained from an organism and can be used in a diagnostic or monitoring assay. The term encompasses blood and other liquid samples of biological origin, solid tissue samples, such as a biopsy specimen or tissue cultures or cells derived therefrom and the progeny thereof. The term encompasses samples that have been manipulated in any way after their procurement, such as by treatment with reagents, solubilization, or enrichment for certain components. The term encompasses a clinical sample, and also includes cells in cell culture, cell supernatants, cell lysates, serum, plasma, biological fluids, and tissue samples.

The terms "treatment", "treating", "treat" and the like are used herein to generally refer to obtaining a desired pharmacologic and/or physiologic effect. The effect may be prophylactic in terms of completely or partially preventing a disease or symptom thereof and/or may be therapeutic in terms of a partial or complete stabilization or cure for a disease and/or adverse effect attributable to the disease. "Treatment" as used herein covers any treatment of a disease in a mammal, particularly a human, and includes: (a) preventing the disease or symptom from occurring in a subject which may be predisposed to the disease or symptom but has not yet been diagnosed as having it; (b) inhibiting the disease symptom, i.e., arresting its development; or (c) relieving the disease symptom, i.e., causing regression of the disease or symptom.

The terms "individual," "subject," "host," and "patient," used interchangeably herein and refer to any mammalian subject for whom diagnosis, treatment, or therapy is desired, particularly humans. Other subjects may include cattle, dogs, cats, guinea pigs, rabbits, rats, mice, horses, and the like.

A "host cell", as used herein, refers to a microorganism or a eukaryotic cell or cell line cultured as a unicellular entity which can be, or has been, used as a recipient for a recombinant vector or other transfer polynucleotides, and include the progeny of the original cell which has been transfected. It is understood that the progeny of a single cell may not necessarily be completely identical in morphology or in genomic or total DNA complement as the original parent, due to natural, accidental, or deliberate mutation.

The terms "cancer", "neoplasm", "tumor", and "carcinoma", are used interchangeably herein to refer to cells which exhibit relatively autonomous growth, so that they exhibit an aberrant growth phenotype characterized by a significant loss of control of cell proliferation. In general, cells of interest for detection or treatment in the present application include precancerous (e.g., benign), malignant, pre-metastatic, metastatic, and non-metastatic cells. Detection of cancerous cells is of particular interest.

The term "normal" as used in the context of "normal cell," is meant to refer to a cell of an untransformed phenotype or exhibiting a morphology of a non-transformed cell of the tissue type being examined.

"Cancerous phenotype" generally refers to any of a variety of biological phenomena that are characteristic of a cancerous cell, which phenomena can vary with the type of cancer. The cancerous phenotype is generally identified by abnormalities in, for example, cell growth or proliferation (e.g., uncontrolled growth or proliferation), regulation of the cell cycle, cell mobility, cell-cell interaction, or metastasis, etc.

"Therapeutic target" generally refers to a gene or gene product that, upon modulation of its activity (e.g., by modulation of expression, biological activity, and the like), can provide for modulation of the cancerous phenotype.

As used throughout, "modulation" is meant to refer to an increase or a decrease in the indicated phenomenon (e.g., modulation of a biological activity refers to an increase in a biological activity or a decrease in a biological activity).

As used herein a "Group I type tumor" is a tumor comprising cells that, relative to a non-cancer cell of the same tissue type, exhibit increased expression of a gene product encoded by at least one or more of the following genes: IGF2, TTK, MAPKAPK2, MARCKS, BBS2, CETN2 CGI-148 protein, FGFR4, FHL3, FLJ22066, KIP2, MGC:29604, NQO2, and OGG1.

As used herein a "Group II type tumor" is a tumor comprising cells that, relative to a non-cancer cell of the same tissue type, exhibit increased expression of a gene product encoded by at least one or more of the following genes: IFITM (1-8U; 1-8D; 9-27), ITAK, and BIRC3/H-IAP 1.

As used herein a "Group I+II type tumor" is a tumor comprising cells that, relative to a non-cancer cell of the same tissue type, exhibit increased expression of 1) a gene product encoded by at least one or more of the following genes: IGF2, TTK, MAPKAPK2, MARCKS, BBS2, CETN2 CGI-148 protein, FGFR4, FHL3, FLJ22066, KIP2, MGC:29604, NQO2, and OGG1; and a gene product encoded by at least one or more of the following genes 2) IFITM (1-8U; 1-8D; 9-27), ITAK, and BIRC3/H-IAP1.

By "chondroitin 4-O sulfotransferase" is meant any polypeptide composition that exhibits chondroitin 4-O sulfotransferase activity. Examples of chondroitin 4-0 sulfotransferases include chondroitin 4-O sulfotransferase-1, -2, -3, defined by NCBI accession numbers AAF81691, AAF81692, and AAM55481, respectively. Assays for determining whether a polypeptide has chondroitin 4-O sulfotransferase activity are described in Burkart & Wong (*Anal Biochem* 274:131-137 (1999)), and further described below. Variants of chondroitin 4-O sulfotransferase include enzymes that retain chondroitin 4-O sulfotransferase activity, i.e. a sulfotransferase activity that is specific for chondroitin over other substrates. Variants of chondroitin 4-O sulfotransferase-1, -2, -3 that retain biological activity may be produced by substituting amino acids that are in equivalent positions between two chondroitin 4-O sulfotransferases, such as chondroitin 4-O sulfotransferase-1 and chondroitin 4-O sulfotransferase-2. A chondroitin 4-O sulfotransferase activity of interest is chondroitin 4-O sulfotransferase 2, (C4S-2).

Figure 37:
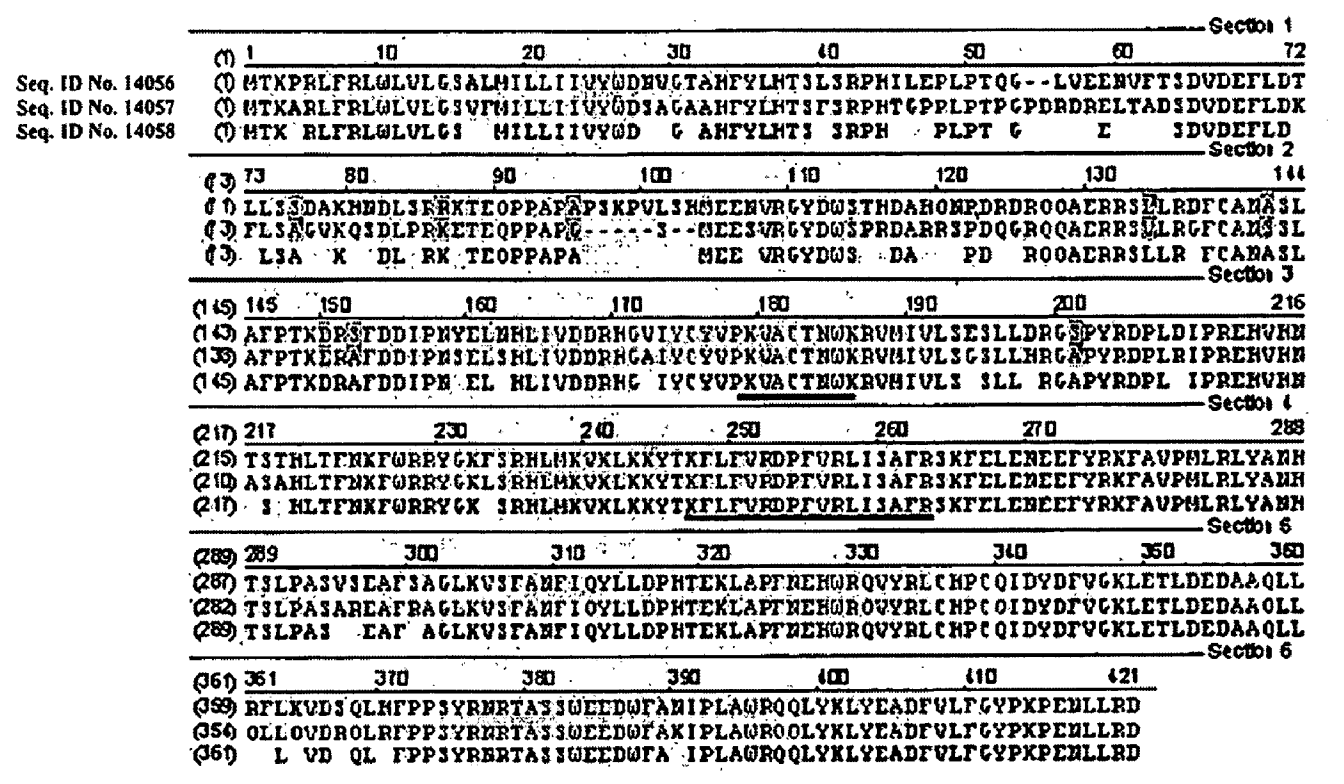

By "chondroitin 4-O sulfotransferase 2" is meant a polypeptide that has chondroitin 4-O sulfotransferase activity and has significant sequence identity to the chondroitin 4-O sulfotransferase 2 of humans (NCBI accession number NP_061111) or mouse (NCBI accession number NP_067503). The alignment between these two polypeptides (mouse C4S-2 at the top and human C4S-2 at the bottom) is shown in FIG. 37 (from Hiraoaka at al JBC 2000 275: 20188-96). Conserved sequences that are active sites, important for binding phosphate and phosphosulphate groups, are underlined in this figure. Variants of chondroitin 4-O sulfotransferase 2 that have chondroitin 4-O sulfotransferase 2 activity include the human and mice chondroitin 4-O sulfotransferase 2 polypeptides, and, for example, polypeptides that contain substitutions of amino acids at equivalent positions from e.g. the mouse to the human polypeptides. Amino acids at positions 4, 16, 17, 28 and 29 are examples of such amino acids. Chondroitin 4-O sulfotransferase 2 has specificity for certain substrates with respect to other chondroitin 4-O sulfotransferases.

With regard to chondroitin 4-O sulfotransferases, further references of interest include Hiraoaka at al JBC 2000 275: 20188-96, Ricciardelli et al. Cancer Res. May 15, 1999; 59(10):2324-8, Ricciardelli et al. Clin Cancer Res. June 1997; 3(6):983-92, Iida et al. Semin Cancer Biol. June 1996; 7(3): 155-62, Yamori et al. J Cell Biochem. April 1988; 36(4):405-16, Denholm et al. Eur J Pharmacol. Mar. 30, 2001; 416(3): 213-21 and Bowman and Bertozzi Chem Biol. January 1999; 6(1):R9-R22.

A "chondroitin 4-O sulfotransferase-related disorder" is a disorder that is associated with the abnormal expression (i.e. increased or decreased expression) of a chondroitin 4-O sulfotransferase or variant thereof. In certain embodiments, the "chondroitin 4-O sulfotransferase-related disorder" is a "chondroitin 4-O sulfotransferase-2-related disorder" associated with the abnormal expression of chondroitin 4-O sulfotransferase-2 or a variant thereof. These disorders are usually related to cancer, in particular cancers of the breast, colon, lung, brain, skin etc. In certain embodiments, the disorder relates to prostate cancer.

By "cyclin G associated kinase", or "GAK" is meant any polypeptide composition that exhibits cyclin G associated kinase activity. Examples of cyclin G associated kinase include the polypeptide defined by NCBI accession number XM_003450, NM_005255, NP_005246 and NM_031030. Assays for determining whether a polypeptide has cyclin G associated kinase activity are described in Ausubel et al., eds., 1998, Current Protocols in Molecular Biology, John Wiley & Sons, NY. Variants of the human cyclin G associated kinase that retain biological activity may be produced by, inter alia, substituting amino acids that are in equivalent positions between two cyclin G associated kinases, such as the cyclin G associated kinases from rat and humans.

With regard to cyclin G associated kinases, further references of interest include: Kanaoka et al, FEBS Lett. Jan. 27, 1997; 402(1):73-80; Kimura et al, Genomics. Sep. 1, 1997; 44 (2):179-87; Greener et al, J Biol Chem. Jan. 14, 2000; 275(2):1365-70; and Korolchuk et al, Traffic. June 2002; 3(6):428-39.

"DKFZp566I133" and "DKFZ" are used interchangeably herein to refer to a polypeptide composition that exhibits DKFZp566I133 activity. Assays for determining whether a polypeptide has DKFZp566I133 activity (i.e. for determining whether DKFZp566I133 may have intracytoplasmatic vacuole promoting activity) are described in Dusetti et al, (Biochem Biophys Res Commun. Jan. 18, 2002; 290(2):641-9). Variants of the DKFZp566I133 that retain biological activity may be produced by, inter alia, substituting amino acids that are in equivalent positions between two DKFZp566I133, such as the DKFZp566I133 from rat and humans. DKFZ is also known as VMP1, or vacuole membrane protein 1.

Alternatively, "DKFZp566I133", or "DKFZ" refers to an amino acid sequence defined by NCBI accession number NP_112200, AAH09758, NM_138839, and NM_030938, polynucleotides encoding the amino acid sequences set forth in these accession numbers (SEQ ID NO:3017 and SEQ ID NO: 3018, respectively).

In addition, "DKFZp566I133", or "DKFZ" refers to the polynucleotide sequences represented by Spot ID NOS 22793, 26883 and 27450 (SEQ ID NOS: 2779-2780 and SEQ ID NOS: 2781-2782 and SEQ ID NOS: 2964-2965, respectively). FIG. 41 shows an alignment between Spot ID NOS: 22793, 26883 and VMP1 (NM_030938) (i.e. DKFZ), identifying a VMP1 or DKFZ gene product as corresponding to these spot IDs. FIG. 42 depicts fragments of Spot ID NOS 22793, 26883, 27450 which align with VMP1 (SEQ ID NOS 3019, 3020, and 3021 respectively). These fragments, or their encoded products, may also be used as a DKFZ identifying sequence.

Polynucleotide Compositions

The present invention provides isolated polynucleotides that contain nucleic acids that are differentially expressed in cancer cells. The polynucleotides, as well as any polypeptides encoded thereby, find use in a variety of therapeutic and diagnostic methods.

The scope of the invention with respect to compositions containing the isolated polynucleotides useful in the methods described herein includes, but is not necessarily limited to, polynucleotides having (i.e., comprising) a sequence set forth in any one of the polynucleotide sequences provided herein, or fragment thereof; polynucleotides obtained from the biological materials described herein or other biological sources (particularly human sources) by hybridization under stringent conditions (particularly conditions of high stringency); genes corresponding to the provided polynucleotides; cDNAs corresponding to the provided polynucleotides; variants of the provided polynucleotides and their corresponding genes, particularly those variants that retain a biological activity of the encoded gene product (e.g., a biological activity ascribed to a gene product corresponding to the provided polynucleotides as a result of the assignment of the gene product to a protein family(ies) and/or identification of a functional domain present in the gene product). Other nucleic acid compositions contemplated by and within the scope of the present invention will be readily apparent to one of ordinary skill in the art when provided with the disclosure here. "Polynucleotide" and "nucleic acid" as used herein with reference to nucleic acids of the composition is not intended to be limiting as to the length or structure of the nucleic acid unless specifically indicated.

The invention features polynucleotides that represent genes that are expressed in human tissue, specifically polynucleotides that are differentially expressed in tissues containing cancerous cells. Nucleic acid compositions described herein of particular interest are at least about 15 bp in length, at least about 30 bp in length, at least about 50 bp in length, at least about 100 bp, at least about 200 bp in length, at least about 300 bp in length, at least about 500 bp in length, at least about 800 bp in length, at least about 1 kb in length, at least about 2.0 kb in length, at least about 3.0 kb in length, at least about 5 kb in length, at least about 10 kb in length, at least about 50 kb in length and are usually less than about 200 kb in length. These polynucleotides (or polynucleotide fragments) have uses that include, but are not limited to, diagnostic probes and primers as starting materials for probes and primers, as discussed herein.

The subject polynucleotides usually comprise a sequence set forth in any one of the polynucleotide sequences provided herein, for example, in the sequence listing, incorporated by reference in a table (e.g. by an NCBI accession number), a cDNA deposited at the A.T.C.C., or a fragment or variant thereof. A "fragment" or "portion" of a polynucleotide is a contiguous sequence of residues at least about 10 nt to about 12 nt, 15 nt, 16 nt, 18 nt or 20 nt in length, usually at least about 22 nt, 24 nt, 25 nt, 30 nt, 40 nt, 50 nt, 60 nt, 70 nt, 80 nt, 90 nt, 100 nt to at least about 150 nt, 200 nt, 250 nt, 300 nt, 350 nt, 400 nt, 500 nt, 800 nt or up to about 1000 nt, 1500 or 2000 nt in length. In some embodiments, a fragment of a polynucleotide is the coding sequence of a polynucleotide. A fragment of a polynucleotide may start at position 1 (i.e. the first nucleotide) of a nucleotide sequence provided herein, or may start at about position 10, 20, 30, 50, 75, 100, 150, 200, 250, 300, 350, 400, 450, 500, 600, 700, 800, 900, 1000, 1500 or 2000, or an ATG translational initiation codon of a nucleotide sequence provided herein. In this context "about" includes the particularly recited value or a value larger or smaller by several (5, 4, 3, 2, or 1) nucleotides. The described polynucleotides and fragments thereof find use as hybridization probes, PCR primers, BLAST probes, or as an identifying sequence, for example.

The subject nucleic acids may be variants or degenerate variants of a sequence provided herein. In general, a variants of a polynucleotide provided herein have a fragment of sequence identity that is greater than at least about 65%, greater than at least about 70%, greater than at least about 75%, greater than at least about 80%, greater than at least about 85%, or greater than at least about 90%, 95%, 96%, 97%, 98%, 99% or more (i.e. 100%) as compared to an identically sized fragment of a provided sequence. as determined by the Smith-Waterman homology search algorithm as implemented in MPSRCH program (Oxford Molecular). For the purposes of this invention, a preferred method of calculating percent identity is the Smith-Waterman algorithm. Global DNA sequence identity should be greater than 65% as determined by the Smith-Waterman homology search algorithm as implemented in MPSRCH program (Oxford Molecular) using an gap search with the following search parameters: gap open penalty, 12; and gap extension penalty, 1.

The subject nucleic acid compositions include full-length cDNAs or mRNAs that encompass an identifying sequence of contiguous nucleotides from any one of the polynucleotide sequences provided herein.

As discussed above, the polynucleotides useful in the methods described herein also include polynucleotide variants having sequence similarity or sequence identity. Nucleic acids having sequence similarity are detected by hybridization under low stringency conditions, for example, at 50° C. and 10×SSC (0.9 M saline/0.09 M sodium citrate) and remain bound when subjected to washing at 55° C. in 1×SSC. Sequence identity can be determined by hybridization under high stringency conditions, for example, at 50° C. or higher and 0.1×SSC (9 mM saline/0.9 mM sodium citrate). Hybridization methods and conditions are well known in the art, see, e.g., U.S. Pat. No. 5,707,829. Nucleic acids that are substantially identical to the provided polynucleotide sequences, e.g. allelic variants, genetically altered versions of the gene, etc., bind to the provided polynucleotide sequences under stringent hybridization conditions. By using probes, particularly labeled probes of DNA sequences, one can isolate homologous or related genes. The source of homologous genes can be any species, e.g. primate species, particularly human; rodents, such as rats and mice; canines, felines, bovines, ovines, equines, yeast, nematodes, etc.

In one embodiment, hybridization is performed using a fragment of at least 15 contiguous nucleotides (nt) of at least one of the polynucleotide sequences provided herein. That is, when at least 15 contiguous nt of one of the disclosed polynucleotide sequences is used as a probe, the probe will preferentially hybridize with a nucleic acid comprising the complementary sequence, allowing the identification and retrieval of the nucleic acids that uniquely hybridize to the selected probe. Probes from more than one polynucleotide sequence provided herein can hybridize with the same nucleic acid if the cDNA from which they were derived corresponds to one mRNA.

Polynucleotides contemplated for use in the invention also include those having a sequence of naturally occurring variants of the nucleotide sequences (e.g., degenerate variants (e.g., sequences that encode the same polypeptides but, due to the degenerate nature of the genetic code, different in nucleotide sequence), allelic variants, etc.). Variants of the polynucleotides contemplated by the invention are identified by hybridization of putative variants with nucleotide sequences disclosed herein, preferably by hybridization under stringent conditions. For example, by using appropriate wash conditions, variants of the polynucleotides described herein can be identified where the allelic variant exhibits at most about 25-30% base pair (bp) mismatches relative to the selected polynucleotide probe. In general, allelic variants contain 15-25% bp mismatches, and can contain as little as even 5-15%, or 2-5%, or 1-2% bp mismatches, as well as a single bp mismatch.

The invention also encompasses homologs corresponding to any one of the polynucleotide sequences provided herein, where the source of homologous genes can be any mammalian species, e.g., primate species, particularly human; rodents, such as rats; canines, felines, bovines, ovines, equines, yeast, nematodes, etc. Between mammalian species, e.g., human and mouse, homologs generally have substantial sequence similarity, e.g., at least 75% sequence identity, usually at least 80%%, at least 85, at least 90%, at least 95%, at least 96%, at least 97%, at least 98%, at least 99% or even 100% identity between nucleotide sequences. Sequence similarity is calculated based on a reference sequence, which may be a subset of a larger sequence, such as a conserved motif, coding region, flanking region, etc. A reference sequence will usually be at least about a fragment of a polynucleotide sequence and may extend to the complete sequence that is being compared. Algorithms for sequence analysis are known in the art, such as gapped BLAST, described in Altschul, et al. Nucleic Acids Res. (1997) 25:3389-3402, or TeraBLAST available from TimeLogic Corp. (Crystal Bay, Nev.).

The subject nucleic acids can be cDNAs or genomic DNAs, as well as fragments thereof, particularly fragments that encode a biologically active gene product and/or are useful in the methods disclosed herein (e.g., in diagnosis, as a unique identifier of a differentially expressed gene of interest, etc.). The term "cDNA" as used herein is intended to include all nucleic acids that share the arrangement of sequence elements found in native mature mRNA species, where sequence elements are exons and 3' and 5' non-coding regions. Normally mRNA species have contiguous exons, with the intervening introns, when present, being removed by nuclear RNA splicing, to create a continuous open reading frame encoding a polypeptide. mRNA species can also exist with both exons and introns, where the introns may be removed by alternative splicing. Furthermore it should be noted that different species of mRNAs encoded by the same genomic sequence can exist at varying levels in a cell, and detection of these various levels of mRNA species can be indicative of differential expression of the encoded gene product in the cell.

A genomic sequence of interest comprises the nucleic acid present between the initiation codon and the stop codon, as defined in the listed sequences, including all of the introns that are normally present in a native chromosome. It can further include the 3' and 5' untranslated regions found in the mature mRNA. It can further include specific transcriptional and translational regulatory sequences, such as promoters, enhancers, etc., including about 1 kb, but possibly more, of flanking genomic DNA at either the 5' and 3' end of the transcribed region. The genomic DNA can be isolated as a fragment of 100 kbp or smaller; and substantially free of flanking chromosomal sequence. The genomic DNA flanking the coding region, either 3' and 5', or internal regulatory sequences as sometimes found in introns, contains sequences required for proper tissue, stage-specific, or disease-state specific expression.

The nucleic acid compositions of the subject invention can encode all or a part of the naturally-occurring polypeptides.

Double or single stranded fragments can be obtained from the DNA sequence by chemically synthesizing oligonucleotides in accordance with conventional methods, by restriction enzyme digestion, by PCR amplification, etc.

Probes specific to the polynucleotides described herein can be generated using the polynucleotide sequences disclosed herein. The probes are usually a fragment of a polynucleotide sequences provided herein. The probes can be synthesized chemically or can be generated from longer polynucleotides using restriction enzymes. The probes can be labeled, for example, with a radioactive, biotinylated, or fluorescent tag. Preferably, probes are designed based upon an identifying sequence of any one of the polynucleotide sequences provided herein. More preferably, probes are designed based on a contiguous sequence of one of the subject polynucleotides that remain unmasked following application of a masking program for masking low complexity (e.g., XBLAST, RepeatMasker, etc.) to the sequence, i.e., one would select an unmasked region, as indicated by the polynucleotides outside the poly-n stretches of the masked sequence produced by the masking program.

The polynucleotides of interest in the subject invention are isolated and obtained in substantial purity, generally as other than an intact chromosome. Usually, the polynucleotides, either as DNA or RNA, will be obtained substantially free of other naturally-occurring nucleic acid sequences that they are usually associated with, generally being at least about 50%, usually at least about 90% pure and are typically "recombinant", e.g., flanked by one or more nucleotides with which it is not normally associated on a naturally occurring chromosome.

The polynucleotides described herein can be provided as a linear molecule or within a circular molecule, and can be provided within autonomously replicating molecules (vectors) or within molecules without replication sequences. Expression of the polynucleotides can be regulated by their own or by other regulatory sequences known in the art. The polynucleotides can be introduced into suitable host cells using a variety of techniques available in the art, such as transferrin polycation-mediated DNA transfer, transfection with naked or encapsulated nucleic acids, liposome-mediated DNA transfer, intracellular transportation of DNA-coated latex beads, protoplast fusion, viral infection, electroporation, gene gun, calcium phosphate-mediated transfection, and the like.

The nucleic acid compositions described herein can be used to, for example, produce polypeptides, as probes for the detection of mRNA in biological samples (e.g., extracts of human cells) or cDNA produced from such samples, to generate additional copies of the polynucleotides, to generate ribozymes or antisense oligonucleotides, and as single stranded DNA probes or as triple-strand forming oligonucleotides. The probes described herein can be used to, for example, determine the presence or absence of any one of the polynucleotide provided herein or variants thereof in a sample. These and other uses are described in more detail below.

Polypeptides and Variants Thereof

The present invention further provides polypeptides encoded by polynucleotides that represent genes that are differentially expressed in cancer cells. Such polypeptides are referred to herein as "polypeptides associated with cancer." The polypeptides can be used to generate antibodies specific for a polypeptide associated with cancer, which antibodies are in turn useful in diagnostic methods, prognostics methods, therametric methods, and the like as discussed in more detail herein. Polypeptides are also useful as targets for therapeutic intervention, as discussed in more detail herein.

The polypeptides contemplated by the invention include those encoded by the disclosed polynucleotides and the genes to which these polynucleotides correspond, as well as nucleic acids that, by virtue of the degeneracy of the genetic code, are not identical in sequence to the disclosed polynucleotides. Further polypeptides contemplated by the invention include polypeptides that are encoded by polynucleotides that hybridize to polynucleotide of the sequence listing. Thus, the invention includes within its scope a polypeptide encoded by a polynucleotide having the sequence of any one of the polynucleotide sequences provided herein, or a variant thereof.

In general, the term "polypeptide" as used herein refers to both the full length polypeptide encoded by the recited polynucleotide, the polypeptide encoded by the gene represented by the recited polynucleotide, as well as portions or fragments thereof. "Polypeptides" also includes variants of the naturally occurring proteins, where such variants are homologous or substantially similar to the naturally occurring protein, and can be of an origin of the same or different species as the naturally occurring protein (e.g., human, murine, or some other species that naturally expresses the recited polypeptide, usually a mammalian species). In general, variant polypeptides have a sequence that has at least about 80%, usually at least about 90%, and more usually at least about 98% sequence identity with a differentially expressed polypeptide described herein, as measured by BLAST 2.0 using the parameters described above. The variant polypeptides can be naturally or non-naturally glycosylated, i.e., the polypeptide has a glycosylation pattern that differs from the glycosylation pattern found in the corresponding naturally occurring protein.

The invention also encompasses homologs of the disclosed polypeptides (or fragments thereof) where the homologs are isolated from other species, i.e. other animal or plant species, where such homologs, usually mammalian species, e.g. rodents, such as mice, rats; domestic animals, e.g., horse, cow, dog, cat; and humans. By "homolog" is meant a polypeptide having at least about 35%, usually at least about 40% and more usually at least about 60% amino acid sequence identity to a particular differentially expressed protein as identified above, where sequence identity is determined using the BLAST 2.0 algorithm, with the parameters described supra.

In general, the polypeptides of interest in the subject invention are provided in a non-naturally occurring environment, e.g. are separated from their naturally occurring environment. In certain embodiments, the subject protein is present in a composition that is enriched for the protein as compared to a cell or extract of a cell that naturally produces the protein. As such, isolated polypeptide is provided, where by "isolated" or "in substantially isolated form" is meant that the protein is present in a composition that is substantially free of other polypeptides, where by substantially free is meant that less than 90%, usually less than 60% and more usually less than 50% of the composition is made up of other polypeptides of a cell that the protein is naturally found.

Also within the scope of the invention are variants; variants of polypeptides include mutants, fragments, and fusions. Mutants can include amino acid substitutions, additions or deletions. The amino acid substitutions can be conservative amino acid substitutions or substitutions to eliminate non-essential amino acids, such as to alter a glycosylation site, a phosphorylation site or an acetylation site, or to minimize misfolding by substitution or deletion of one or more cysteine residues that are not necessary for function. Conservative amino acid substitutions are those that preserve the general charge, hydrophobicity/hydrophilicity, and/or steric bulk of the amino acid substituted.

Variants can be designed so as to retain or have enhanced biological activity of a particular region of the protein (e.g., a functional domain and/or, where the polypeptide is a member of a protein family, a region associated with a consensus sequence). For example, muteins can be made which are optimized for increased antigenicity, i.e. amino acid variants of a polypeptide may be made that increase the antigenicity of the polypeptide. Selection of amino acid alterations for production of variants can be based upon the accessibility (interior vs. exterior) of the amino acid (see, e.g., Go et al, *Int. J. Peptide Protein Res.* (1980) 15:211), the thermostability of the variant polypeptide (see, e.g., Querol et al., *Prot. Eng.* (1996) 9:265), desired glycosylation sites (see, e.g., Olsen and Thomsen, *J. Gen. Microbiol.* (1991) 137:579), desired disulfide bridges (see, e.g., Clarke et al., *Biochemistry* (1993) 32:4322; and Wakarchuk et al., *Protein Eng.* (1994) 7:1379), desired metal binding sites (see, e.g., Toma et al., *Biochemistry* (1991) 30:97, and Haezerbrouck et al., *Protein Eng.* (1993) 6:643), and desired substitutions with in proline loops (see, e.g., Masul et al., *Appl. Env. Microbiol.* (1994) 60:3579). Cysteine-depleted muteins can be produced as disclosed in U.S. Pat. No. 4,959,314. Variants also include fragments of the polypeptides disclosed herein, particularly biologically active fragments and/or fragments corresponding to functional domains. Fragments of interest will typically be at least about 10 aa to at least about 15 aa in length, usually at least about 50 aa in length, and can be as long as 300 aa in length or longer, but will usually not exceed about 1000 aa in length, where the fragment will have a stretch of amino acids that is identical to a polypeptide encoded by a polynucleotide having a sequence of any one of the polynucleotide sequences provided herein, or a homolog thereof. The protein variants described herein are encoded by polynucleotides that are within the scope of the invention. The genetic code can be used to select the appropriate codons to construct the corresponding variants.

A fragment of a subject polypeptide is, for example, a polypeptide having an amino acid sequence which is a portion of a subject polypeptide e.g. a polypeptide encoded by a subject polynucleotide that is identified by any one of the sequence of SEQ ID NOS: 1-13996 or its complement. The polypeptide fragments of the invention are preferably at least about 9 aa, at least about 15 aa, and more preferably at least about 20 aa, still more preferably at least about 30 aa, and even more preferably, at least about 40 aa, at least about 50 aa, at least about 75 aa, at least about 100 aa, at least about 125 aa or at least about 150 aa in length. A fragment "at least 20 aa in length," for example, is intended to include 20 or more contiguous amino acids from, for example, the polypeptide encoded by a cDNA, in a cDNA clone contained in a deposited library, or a nucleotide sequence shown in SEQ ID NOS: 1-13996 or the complementary stand thereof. In this context "about" includes the particularly recited value or a value larger or smaller by several (5, 4, 3, 2, or 1) amino acids. These polypeptide fragments have uses that include, but are not limited to, production of antibodies as discussed herein. Of course, larger fragments (e.g., at least 150, 175, 200, 250, 500, 600, 1000, or 2000 amino acids in length) are also encompassed by the invention.

Moreover, representative examples of polypeptides fragments of the invention (useful in, for example, as antigens for antibody production), include, for example, fragments comprising, or alternatively consisting of, a sequence from about amino acid number 1-10, 5-10, 10-20, 21-31, 31-40, 41-61, 61-81, 91-120, 121-140, 141-162, 162-200, 201-240, 241-280, 281-320, 321-360, 360-400, 400-450, 451-500, 500-600, 600-700, 700-800, 800-900 and the like. In this context "about" includes the particularly recited range or a range larger or smaller by several (5, 4, 3, 2, or 1) amino acids, at either terminus or at both termini. In some embodiments, these fragments has a functional activity (e.g., biological activity) whereas in other embodiments, these fragments may be used to make an antibody.

In one example, a polynucleotide having a sequence set forth in the sequence listing, containing no flanking sequences (i.e., consisting of the sequence set forth in the sequence listing), may be cloned into an expression vector having ATG and a stop codon (e.g. any one of the pET vector from Invitrogen, or other similar vectors from other manufactures), and used to express a polypeptide of interest encoded by the polynucleotide in a suitable cell, e.g., a bacterial cell. Accordingly, the polynucleotides may be used to produce polypeptides, and these polypeptides may be used to produce antibodies by known methods described above and below. In many embodiments, the sequence of the encoded polypeptide does not have to be known prior to its expression in a cell. However, if it desirable to know the sequence of the polypeptide, this may be derived from the sequence of the polynucleotide. Using the genetic code, the polynucleotide may be translated by hand, or by computer means. Suitable software for identifying open reading frames and translating them into polypeptide sequences are well know in the art, and include: Lasergene™ from DNAStar (Madison, Wis.), and Vector NTI™ from Informax (Frederick Md.), and the like.

Further polypeptide variants may are described in PCT publications WO/00-55173 WO/01-07611 and WO/02-16429

Vectors, Host Cells and Protein Production

The present invention also relates to vectors containing the polynucleotide of the present invention, host cells, and the production of polypeptides by recombinant techniques. The vector may be, for example, a phage, plasmid, viral, or retroviral vector. Retroviral vectors may be replication competent or replication defective. In the latter case, viral propagation generally will occur only in complementing host cells.

The polynucleotides of the invention may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The polynucleotide insert should be operatively linked to an appropriate promoter, such as the phage lambda PL promoter, the E. coli lac, trp, phoA and tac promoters, the SV40 early and late promoters and promoters of retroviral LTRs, to name a few. Other suitable promoters will be known to the skilled artisan. The expression constructs will further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

As indicated, the expression vectors will preferably include at least one selectable marker. Such markers include dihydrofolate reductase, G418 or neomycin resistance for eukaryotic cell culture and tetracycline, kanamycin or ampicillin resistance genes for culturing in E. coli and other bacteria.

Representative examples of appropriate hosts include, but are not limited to, bacterial cells, such as E. coli, Streptomyces and Salmonella typhimurium cells; fungal cells, such as yeast cells (e.g., Saccharomyces cerevisiae or Pichia pastoris (ATCC Accession No. 201178)); insect cells such as Drosophila S2 and Spodoptera Sf9 cells; animal cells such as CHO, COS, 293, and Bowes melanoma cells; and plant cells. Appropriate-culture mediums and conditions for the above-described host cells are known in the art.

Among vectors preferred for use in bacteria include pQE70, pQE60 and pQE-9, available from QIAGEN, Inc.; pBluescript vectors, Phagescript vectors, pNHSA, pNH16a, pNH18A, pNH46A, available from Stratagene Cloning Systems, Inc.; and ptrc99a, pKK223-3, pKK233-3, pDR540, pRITS available from Pharmacia Biotech, Inc. Among preferred eukaryotic vectors are pWLNEO, pSV2CAT, pOG44, pXT1 and pSG available from Stratagene; and pSVK3, pBPV, pMSG and pSVL available from Pharmacia. Preferred expression vectors for use in yeast systems include, but are not limited to pYES2, pYD1, pTEF1/Zeo, pYES2/GS, pPICZ, pGAPZ, pGAPZalph, pPIC9, pPIC3.5, pHIL-D2, pHIL-S1, pPIC3.5K, pPIC9K, and PAO815 (all available from Invitrogen, Carload, Calif.). Other suitable vectors will be readily apparent to the skilled artisan.

Nucleic acids of interest may be cloned into a suitable vector by route methods. Suitable vectors include plasmids, cosmids, recombinant viral vectors e.g. retroviral vectors, YACs, BACs and the like, phage vectors.

Introduction of the construct into the host cell can be effected by calcium phosphate transfection, DEAE-dextran mediated transfection, cationic lipid-mediated transfection, electroporation, transduction, infection, or other methods. Such methods are described in many standard laboratory manuals, such as Davis et al., Basic Methods In Molecular Biology (1986). It is specifically contemplated that the polypeptides of the present invention may in fact be expressed by a host cell lacking a recombinant vector.

A polypeptide of this invention can be recovered and purified from recombinant cell cultures by well-known methods including ammonium-sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification.

Polypeptides of the present invention can also be recovered from: products purified from natural sources, including bodily fluids, tissues and cells, whether directly isolated or cultured; products of chemical synthetic procedures; and products produced by recombinant techniques from a prokaryotic or eukaryotic host, including, for example, bacterial, yeast higher plant, insect, and mammalian cells. Depending upon the host employed in a recombinant production procedure, the polypeptides of the present invention may be glycosylated or may be non-glycosylated. In addition, polypeptides of the invention may also include an initial modified methionine residue, in some cases as a result of host mediated processes. Thus, it is well known in the art that the N-terminal methionine encoded by the translation initiation codon generally is removed with high efficiency from any protein after translation in all eukaryotic cells. While the N-terminal methionine on most proteins also is efficiently removed in most prokaryotes, for some proteins, this prokaryotic removal process is inefficient, depending on the nature of the amino acid to which the N-terminal methionine is covalently linked.

Suitable methods and compositions for polypeptide expression may be found in PCT publications WO/00-55173, WO/01-07611 and WO/02-16429, and suitable methods and compositions for production of modified polypeptides may be found in PCT publications WO/00-55173, WO/01-07611 and WO/02-16429.

Antibodies and Other Polypeptide or Polynucleotide Binding Molecule

The present invention further provides antibodies, which may be isolated antibodies, that are specific for a polypeptide encoded by a polynucleotide described herein and/or a polypeptide of a gene that corresponds to a polynucleotide described herein. Antibodies can be provided in a composition comprising the antibody and a buffer and/or a pharmaceutically acceptable excipient. Antibodies specific for a polypeptide associated with cancer are useful in a variety of diagnostic and therapeutic methods, as discussed in detail herein.

Gene products, including polypeptides, mRNA (particularly mRNAs having distinct secondary and/or tertiary structures), cDNA, or complete gene, can be prepared and used for raising antibodies for experimental, diagnostic, and therapeutic purposes. Antibodies may be used to identify a gene corresponding to a polynucleotide. The polynucleotide or related cDNA is expressed as described above, and antibodies are prepared. These antibodies are specific to an epitope on the polypeptide encoded by the polynucleotide, and can precipitate or bind to the corresponding native protein in a cell or tissue preparation or in a cell-free extract of an in vitro expression system.

Antibodies

Further polypeptides of the invention relate to antibodies and T-cell antigen receptors (TCR) which immunospecifically bind a subject polypeptide, subject polypeptide fragment, or variant thereof, and/or an epitope thereof (as determined by immunoassays well known in the art for assaying specific antibody-antigen binding). Antibodies of the invention include, but are not limited to, polyclonal, monoclonal, multispecific, human, humanized or chimeric antibodies, single chain antibodies, Fab fragments, F(ab') fragments, fragments produced by a Fab expression library, anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, i.e., molecules that contain an antigen binding site that immunospecifically binds an antigen. The immunoglobulin molecules of the invention can be of any type (e.g., IgG, IgE, IgM, IgD, IgA and IgY), class (e.g., IgG1, IgG2, IgG3, IgG4, IgA1 and IgA2) or subclass of immunoglobulin molecule.

Most preferably the antibodies are human antigen-binding antibody fragments of the present invention and include, but are not limited to, Fab, Fab' and F(ab')2, Fd, single-chain Fvs (scFv), single-chain antibodies, disulfide-linked Fvs (sdFv) and fragments comprising either a $V_L$ or $V_H$ domain. Antigen-binding antibody fragments, including single-chain antibodies, may comprise the variable region(s) alone or in combination with the entirety or a portion of the following: hinge region, $C_H1$, $C_H2$, and $C_H3$ domains. Also included in the invention are antigen-binding fragments also comprising any combination of variable region(s) with a hinge region, $C_H1$, $C_H2$, and $C_H3$ domains. The antibodies of the invention may be from any animal origin including birds and mammals. Preferably, the antibodies are human, murine (e.g., mouse and rat), donkey, ship rabbit, goat, guinea pig, camel, horse, or chicken. As used herein, "human" antibodies include antibodies having the amino acid sequence of a human immunoglobulin and include antibodies isolated from, human immunoglobulin libraries or from animals transgenic for one or more human immunoglobulin and that do not express endogenous immunoglobulins, as described infra and, for example in, U.S. Pat. No. 5,939,598 by Kucherlapati et al.

The antibodies of the present invention may be monospecific, bispecific, trispecific or of greater multispecificity. Multispecific antibodies may be specific for different epitopes of a polypeptide of the present invention or may be specific for both a polypeptide of the present invention as well as for a heterologous epitope, such as a heterologous polypeptide or solid support material. See, e.g., PCT publications WO 93/17715; WO 92/08802; WO 91/00360; WO 92/05793; Tutt, et al., J. Immunol. 147:60-69 (199.1); U.S. Pat. Nos. 4,474,893; 4,714,681; 4,925,648; 5,573,920; 5,601,819; Kostelny et al., J. Immunol. 148:1547-1553 (1992).

Antibodies of the present invention may be described or specified in terms of the epitope(s) or portion(s) of a polypeptide of the present invention which they recognize or specifically bind. The epitope(s) or polypeptide portion(s) may be specified as described herein, e.g., by N-terminal and C-terminal positions, or by size in contiguous amino acid residues. Antibodies which specifically bind any epitope or polypeptide of the present invention may also be excluded. Therefore, the present invention includes antibodies that specifically bind polypeptides of the present invention, and allows for the exclusion of the same.

Antibodies of the present invention may also be described or specified in terms of their cross-reactivity. Antibodies that do not bind any other analog, ortholog, or homolog of a polypeptide of the present invention are included. Antibodies that bind polypeptides with at least 95%, at least 90%, at least 85%, at least 80%, at least 75%, at least 70%, at least 65%, at least 60%, at least 55%, and at least 50% identity (as calculated using methods known in the art and described herein) to a polypeptide of the present invention are also included in the present invention. In specific embodiments, antibodies of the present invention cross-react with murine, rat and/or rabbit homologs of human proteins and the corresponding epitopes thereof Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein) to a polypeptide of the present invention are also included in the present invention. In a specific embodiment, the above-described cross-reactivity is with respect to any single specific antigenic or immunogenic polypeptide, or combination(s) of 2, 3, 4, 5, or more of the specific antigenic and/or immunogenic polypeptides disclosed herein. Further included in the present invention are antibodies which bind polypeptides encoded by polynucleotides which hybridize to a polynucleotide of the present invention under stringent hybridization conditions (as described herein). Antibodies of the present invention may also be described or specified in terms of their binding affinity to a polypeptide of the invention. Preferred binding affinities include those with a dissociation constant or Kd less $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, 10-10 M, etc.

The invention also provides antibodies that competitively inhibit binding of an antibody to an epitope of the invention as determined by any method known in the art for determining competitive binding, for example, the immunoassays described herein. In preferred embodiments, the antibody competitively inhibits binding to the epitope by at least 95%, at least 90%, at least 85%, at least 80%, at least 75%, at least 70%, at least 60%, or at least 50%.

Methods for making screening, assaying, humanizing, and modifying different types of antibody are well known in the art and may be found in PCT publications WO/00-55173, WO/01-07611 and WO/02-16429.

In addition, the invention further provides polynucleotides comprising a nucleotide sequence encoding an antibody of the invention and fragments thereof. The invention also encompasses polynucleotides that hybridize under stringent or alternatively, under lower stringency hybridization conditions, e.g., as defined supra, to polynucleotides that encode an antibody, preferably, that specifically binds to a polypeptide of the invention, preferably, an antibody that binds to a subject polypeptide.

The antibodies of the invention can be produced by any method known in the art for the synthesis of antibodies, in particular, by chemical synthesis or preferably, by recombinant expression techniques. Recombinant expression of an antibody of the invention, or fragment, derivative or analog thereof, (e.g., a heavy or light chain of an antibody of the invention or a single chain antibody of the invention), requires construction of an expression vector containing a polynucleotide that encodes the antibody. Once a polynucleotide encoding an antibody molecule or a heavy or light chain of an antibody, or portion thereof (preferably containing the heavy or light chain variable domain), of the invention has been obtained, the vector for the production of the antibody molecule may be produced by recombinant DNA technology using techniques well known in the art. Thus, methods for preparing a protein by expressing a polynucleotide containing an antibody encoding nucleotide sequence are described herein. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding an antibody molecule of the invention, or a heavy or light chain thereof, or a heavy or light chain variable domain, operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464) and the variable domain of the antibody may be cloned into such a vector for expression of the entire heavy or light chain.

The expression vector is transferred to a host cell by conventional techniques and the transfected cells are then cultured by conventional techniques to produce an antibody of the invention. Thus, the invention includes host cells containing a polynucleotide encoding an antibody of the invention, or a heavy or light chain thereof, or a single chain antibody of the invention, operably linked to a heterologous promoter. In preferred embodiments for the expression of double-chained antibodies, vectors encoding both the heavy and light chains may be co-expressed in the host cell for expression of the entire immunoglobulin molecule, as detailed below.

A variety of host-expression vector systems may be utilized to express the antibody molecules of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. These include but are not limited to microorganisms such as bacteria (e.g., *E. coli, B. subtilis*) transformed with recombinant bacteriophage DNA, plasmid DNA or cosmid DNA expression vectors containing antibody coding sequences; yeast (e.g., *Saccharomyces, Pichia*) transformed with recombinant yeast expression vectors containing antibody coding sequences; insect cell systems infected with recombinant virus expression vectors (e.g., baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). Preferably, bacterial cells such as *Escherichia coli*, and more preferably, eukaryotic cells, especially for the expression of whole recombinant antibody molecule, are used for the expression of a recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., Bio/Technology 8:2 (1990)).

Antibodies production is well known in the art. Exemplary methods and compositions for making antibodies may be found in PCT publications WO/00-55173, WO/01-07611 and WO/02-16429.

Immunophenotyping

The antibodies of the invention may be utilized for immunophenotyping of cell lines and biological samples. The translation product of the gene of the present invention may be useful as a cell specific marker, or more specifically as a cellular marker that is differentially expressed at various stages of differentiation and/or maturation of particular cell types. Monoclonal antibodies directed against a specific epitope, or combination of epitopes, will allow for the screening of cellular populations expressing the marker. Various techniques can be utilized using monoclonal antibodies to screen for cellular populations expressing the marker(s), and include magnetic separation using antibody-coated magnetic beads, "panning" with antibody attached to a solid matrix (i.e., plate), and flow cytometry (See, e.g., U.S. Pat. No. 5,985,660; and Morrison et al. Cell, 96:737-49 (1999)).

These techniques allow for the screening of particular populations of cells, such as might be found with hematological malignancies (i.e. minimal residual disease (MRD) in acute leukemic patients) and "non-self cells in transplantations to prevent Graft-versus-Host Disease (GVHD). Alternatively, these techniques allow for the screening of hematopoietic stem and progenitor cells capable of undergoing proliferation and/or differentiation, as might be found in human umbilical cord blood.

Kits

Also provided by the subject invention are kits for practicing the subject methods, as described above. The subject kits include at least one or more of: a subject nucleic acid, isolated polypeptide or an antibody thereto. Other optional components of the kit include: restriction enzymes, control primers and plasmids; buffers, cells, carriers adjuvants etc. The nucleic acids of the kit may also have restrictions sites, multiple cloning sites, primer sites, etc to facilitate their ligation other plasmids. The various components of the kit may be present in separate containers or certain compatible components may be precombined into a single container, as desired. In many embodiments, kits with unit doses of the active agent, e.g. in oral or injectable doses, are provided. In certain embodiments, controls, such as samples from a cancerous or non-cancerous cell are provided by the invention. Further embodiments of the kit include an antibody for a subject polypeptide and a chemotherapeutic agent to be used in combination with the polypeptide as a treatment.

In addition to above-mentioned components, the subject kits typically further include instructions for using the components of the kit to practice the subject methods. The instructions for practicing the subject methods are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

Computer-Related Embodiments

In general, a library of polynucleotides is a collection of sequence information, which information is provided in either biochemical form (e.g., as a collection of polynucleotide molecules), or in electronic form (e.g., as a collection of polynucleotide sequences stored in a computer-readable form, as in a computer system and/or as part of a computer program). The sequence information of the polynucleotides can be used in a variety of ways, e.g., as a resource for gene discovery, as a representation of sequences expressed in a selected cell type (e.g., cell type markers), and/or as markers of a given disease or disease state. For example, in the instant case, the sequences of polynucleotides and polypeptides corresponding to genes differentially expressed in cancer, as well as the nucleic acid and amino acid sequences of the genes themselves, can be provided in electronic form in a computer database.

In general, a disease marker is a representation of a gene product that is present in all cells affected by disease either at an increased or decreased level relative to a normal cell (e.g., a cell of the same or similar type that is not substantially affected by disease). For example, a polynucleotide sequence in a library can be a polynucleotide that represents an mRNA, polypeptide, or other gene product encoded by the polynucleotide, that is either overexpressed or underexpressed in a cancerous cell affected by cancer relative to a normal (i.e., substantially disease-free) cell.

The nucleotide sequence information of the library can be embodied in any suitable form, e.g., electronic or biochemical forms. For example, a library of sequence information embodied in electronic form comprises an accessible computer data file (or, in biochemical form, a collection of nucleic acid molecules) that contains the representative nucleotide sequences of genes that are differentially expressed (e.g., overexpressed or underexpressed) as between, for example, i) a cancerous cell and a normal cell; ii) a cancerous cell and a dysplastic cell; iii) a cancerous cell and a cell affected by a disease or condition other than cancer; iv) a metastatic cancerous cell and a normal cell and/or non-metastatic cancerous cell; v) a malignant cancerous cell and a non-malignant cancerous cell (or a normal cell) and/or vi) a dysplastic cell relative to a normal cell. Other combinations and comparisons of cells affected by various diseases or stages of disease will be readily apparent to the ordinarily skilled artisan. Biochemical embodiments of the library include a collection of nucleic acids that have the sequences of the genes in the library, where the nucleic acids can correspond to the entire gene in the library or to a fragment thereof, as described in greater detail below.

The polynucleotide libraries of the subject invention generally comprise sequence information of a plurality of polynucleotide sequences, where at least one of the polynucleotides has a sequence of any of sequence described herein. By plurality is meant at least 2, usually at least 3 and can include up to all of the sequences described herein. The length and number of polynucleotides in the library will vary with the nature of the library, e.g., if the library is an oligonucleotide array, a cDNA array, a computer database of the sequence information, etc.

Where the library is an electronic library, the nucleic acid sequence information can be present in a variety of media. "Media" refers to a manufacture, other than an isolated nucleic acid molecule, that contains the sequence information of the present invention. Such a manufacture provides the genome sequence or a subset thereof in a form that can be examined by means not directly applicable to the sequence as it exists in a nucleic acid. For example, the nucleotide sequence of the present invention, e.g. the nucleic acid sequences of any of the polynucleotides of the sequences described herein, can be recorded on computer readable media, e.g. any medium that can be read and accessed directly by a computer. Such media include, but are not limited to: magnetic storage media, such as a floppy disc, a hard disc storage medium, and a magnetic tape; optical storage media such as CD-ROM; electrical storage media such as RAM and ROM; and hybrids of these categories such as magnetic/optical storage media.

One of skill in the art can readily appreciate how any of the presently known computer readable mediums can be used to create a manufacture comprising a recording of the present sequence information. "Recorded" refers to a process for storing information on computer readable medium, using any such methods as known in the art. Any convenient data storage structure can be chosen, based on the means used to access the stored information. A variety of data processor programs and formats can be used for storage, e.g. word processing text file, database format, etc. In addition to the sequence information, electronic versions of libraries comprising one or more sequence described herein can be provided in conjunction or connection with other computer-readable information and/or other types of computer-readable files (e.g., searchable files, executable files, etc, including, but not limited to, for example, search program software, etc.).

By providing the nucleotide sequence in computer readable form, the information can be accessed for a variety of purposes. Computer software to access sequence information (e.g. the NCBI sequence database) is publicly available. For example, the gapped BLAST (Altschul et al., *Nucleic Acids Res*. (1997) 25:3389-3402) and BLAZE (Brutlag et al, *Comp. Chem*. (1993) 17:203) search algorithms on a Sybase system, or the TeraBLAST (TimeLogic, Crystal Bay, Nev.) program optionally running on a specialized computer platform available from TimeLogic, can be used to identify open reading frames (ORFs) within the genome that contain homology to ORFs from other organisms.

As used herein, "a computer-based system" refers to the hardware means, software means, and data storage means used to analyze the nucleotide sequence information of the present invention. The minimum hardware of the computer-based systems of the present invention comprises a central processing unit (CPU), input means, output means, and data storage means. A skilled artisan can readily appreciate that any one of the currently available computer-based system are suitable for use in the present invention. The data storage means can comprise any manufacture comprising a recording of the present sequence information as described above, or a memory access means that can access such a manufacture.

"Search means" refers to one or more programs implemented on the computer-based system, to compare a target sequence or target structural motif, or expression levels of a polynucleotide in a sample, with the stored sequence information. Search means can be used to identify fragments or regions of the genome that match a particular target sequence or target motif. A variety of known algorithms are publicly known and commercially available, e.g. MacPattern (EMBL), TeraBLAST (TimeLogic), BLASTN and BLASTX (NCBI). A "target sequence" can be any polynucleotide or amino acid sequence of six or more contiguous nucleotides or two or more amino acids, preferably from about 10 to 100 amino acids or from about 30 to 300 nt. A variety of means for comparing nucleic acids or polypeptides may be used to compare accomplish a sequence comparison (e.g., to analyze target sequences, target motifs, or relative expression levels) with the data storage means. A skilled artisan can readily recognize that any one of the publicly available homology search programs can be used to search the computer based systems of the present invention to compare of target sequences and motifs. Computer programs to analyze expression levels in a sample and in controls are also known in the art.

A "target structural motif," or "target motif," refers to any rationally selected sequence or combination of sequences in which the sequence(s) are chosen based on a three-dimensional configuration that is formed upon the folding of the target motif, or on consensus sequences of regulatory or active sites. There are a variety of target motifs known in the art. Protein target motifs include, but are not limited to, enzyme active sites and signal sequences, kinase domains, receptor binding domains, SH2 domains, SH3 domains, phosphorylation sites, protein interaction domains, transmembrane domains, etc. Nucleic acid target motifs include, but are not limited to, hairpin structures, promoter sequences and other expression elements such as binding sites for transcription factors.

A variety of structural formats for the input and output means can be used to input and output the information in the computer-based systems of the present invention. One format for an output means ranks the relative expression levels of different polynucleotides. Such presentation provides a skilled artisan with a ranking of relative expression levels to determine a gene expression profile. A gene expression profile can be generated from, for example, a cDNA library prepared from mRNA isolated from a test cell suspected of being cancerous or pre-cancerous, comparing the sequences or partial sequences of the clones against the sequences in an electronic database, where the sequences of the electronic database represent genes differentially expressed in a cancerous cell, e.g., a cancerous breast cell. The number of clones having a sequence that has substantial similarity to a sequence that represents a gene differentially expressed in a cancerous cell is then determined, and the number of clones corresponding to each of such genes is determined. An increased number of clones that correspond to differentially expressed gene is present in the cDNA library of the test cell (relative to, for example, the number of clones expected in a cDNA of a normal cell) indicates that the test cell is cancerous.

As discussed above, the "library" as used herein also encompasses biochemical libraries of the polynucleotides of the sequences described herein, e.g., collections of nucleic acids representing the provided polynucleotides. The biochemical libraries can take a variety of forms, e.g., a solution of cDNAs, a pattern of probe nucleic acids stably associated with a surface of a solid support (i.e., an array) and the like. Of particular interest are nucleic acid arrays in which one or more of the genes described herein is represented by a sequence on the array. By array is meant an article of manufacture that has at least a substrate with at least two distinct nucleic acid targets on one of its surfaces, where the number of distinct nucleic acids can be considerably higher, typically being at least 10 nt, usually at least 20 nt and often at least 25 nt. A variety of different array formats have been developed and are known to those of skill in the art. The arrays of the subject invention find use in a variety of applications, including gene expression analysis, drug screening, mutation analysis and the like, as disclosed in the above-listed exemplary patent documents.

In addition to the above nucleic acid libraries, analogous libraries of polypeptides are also provided, where the polypeptides of the library will represent at least a portion of the polypeptides encoded by a gene corresponding to a sequence described herein.

Diagnostic and Other Methods Involving Detection of Differentially Expressed Genes The present invention provides methods of using the polynucleotides described herein in, for example, diagnosis of cancer and classification of cancer cells according to expression profiles. In specific non-limiting embodiments, the methods are useful for detecting cancer cells, facilitating diagnosis of cancer and the severity of a cancer (e.g., tumor grade, tumor burden, and the like) in a subject, facilitating a determination of the prognosis of a subject, and assessing the responsiveness of the subject to therapy (e.g., by providing a measure of therapeutic effect through, for example, assessing tumor burden during or following a chemotherapeutic regimen). Detection can be based on detection of a polynucleotide that is differentially expressed in a cancer cell, and/or detection of a polypeptide encoded by a polynucleotide that is differentially expressed in a cancer cell ("a polypeptide associated with cancer"). The detection methods of the invention can be conducted in vitro or in vivo, on isolated cells, or in whole tissues or a bodily fluid, e.g., blood, plasma, serum, urine, and the like).

In general, methods of the invention involving detection of a gene product (e.g., mRNA, cDNA generated from such mRNA, and polypeptides) involve contacting a sample with a probe specific for the gene product of interest. "Probe" as used herein in such methods is meant to refer to a molecule that specifically binds a gene product of interest (e.g., the probe binds to the target gene product with a specificity sufficient to distinguish binding to target over non-specific binding to non-target (background) molecules). "Probes" include, but are not necessarily limited to, nucleic acid probes (e.g., DNA, RNA, modified nucleic acid, and the like), antibodies (e.g., antibodies, antibody fragments that retain binding to a target epitope, single chain antibodies, and the like), or other polypeptide, peptide, or molecule (e.g., receptor ligand) that specifically binds a target gene product of interest.

The probe and sample suspected of having the gene product of interest are contacted under conditions suitable for binding of the probe to the gene product. For example, contacting is generally for a time sufficient to allow binding of the probe to the gene product (e.g., from several minutes to a few hours), and at a temperature and conditions of osmolarity and the like that provide for binding of the probe to the gene product at a level that is sufficiently distinguishable from background binding of the probe (e.g., under conditions that minimize non-specific binding). Suitable conditions for probe-target gene product binding can be readily determined using controls and other techniques available and known to one of ordinary skill in the art.

In this embodiment, the probe can be an antibody or other polypeptide, peptide, or molecule (e.g., receptor ligand) that specifically binds a target polypeptide of interest.

The detection methods can be provided as part of a kit. Thus, the invention further provides kits for detecting the presence and/or a level of a polynucleotide that is differentially expressed in a cancer cell (e.g., by detection of an mRNA encoded by the differentially expressed gene of interest), and/or a polypeptide encoded thereby, in a biological sample. Procedures using these kits can be performed by clinical laboratories, experimental laboratories, medical practitioners, or private individuals. The kits of the invention for detecting a polypeptide encoded by a polynucleotide that is differentially expressed in a cancer cell comprise a moiety that specifically binds the polypeptide, which may be a specific antibody. The kits of the invention for detecting a polynucleotide that is differentially expressed in a cancer cell comprise a moiety that specifically hybridizes to such a polynucleotide. The kit may optionally provide additional components that are useful in the procedure, including, but not limited to, buffers, developing reagents, labels, reacting surfaces, means for detection, control samples, standards, instructions, and interpretive information.

Detecting a Polypeptide Encoded by a Polynucleotide that is Differentially Expressed in a Cancer Cell In some embodiments, methods are provided for a detecting cancer cell by detecting in a cell, a polypeptide encoded by a gene differentially expressed in a cancer cell. Any of a variety of known methods can be used for detection, including, but not limited to, immunoassay, using an antibody specific for the encoded polypeptide, e.g., by enzyme-linked immunosorbent assay (ELISA), radioimmunoassay (RIA), and the like; and functional assays for the encoded polypeptide, e.g., binding activity or enzymatic activity.

For example, an immunofluorescence assay can be easily performed on cells without first isolating the encoded polypeptide. The cells are first fixed onto a solid support, such as a microscope slide or microtiter well. This fixing step can permeabilize the cell membrane. The permeabilization of the cell membrane permits the polypeptide-specific probe (e.g., antibody) to bind. Alternatively, where the polypeptide is secreted or membrane-bound, or is otherwise accessible at the cell-surface (e.g., receptors, and other molecule stably-associated with the outer cell membrane or otherwise stably associated with the cell membrane, such permeabilization may not be necessary.

Next, the fixed cells are exposed to an antibody specific for the encoded polypeptide. To increase the sensitivity of the assay, the fixed cells may be further exposed to a second antibody, which is labeled and binds to the first antibody, which is specific for the encoded polypeptide. Typically, the secondary antibody is detectably labeled, e.g., with a fluorescent marker. The cells which express the encoded polypeptide will be fluorescently labeled and easily visualized under the microscope. See, for example, Hashido et al. (1992) *Biochem. Biophys. Res. Comm.* 187:1241-1248.

As will be readily apparent to the ordinarily skilled artisan upon reading the present specification, the detection methods and other methods described herein can be varied. Such variations are within the intended scope of the invention. For example, in the above detection scheme, the probe for use in detection can be immobilized on a solid support, and the test sample contacted with the immobilized probe. Binding of the test sample to the probe can then be detected in a variety of ways, e.g., by detecting a detectable label bound to the test sample.

The present invention further provides methods for detecting the presence of and/or measuring a level of a polypeptide in a biological sample, which polypeptide is encoded by a polynucleotide that represents a gene differentially expressed in cancer, particularly in a polynucleotide that represents a gene differentially cancer cell, using a probe specific for the encoded polypeptide. In this embodiment, the probe can be a an antibody or other polypeptide, peptide, or molecule (e.g., receptor ligand) that specifically binds a target polypeptide of interest.

The methods generally comprise: a) contacting the sample with an antibody specific for a differentially expressed polypeptide in a test cell; and b) detecting binding between the antibody and molecules of the sample. The level of antibody binding (either qualitative or quantitative) indicates the cancerous state of the cell. For example, where the differentially expressed gene is increased in cancerous cells, detection of an increased level of antibody binding to the test sample relative to antibody binding level associated with a normal cell indicates that the test cell is cancerous.

Suitable controls include a sample known not to contain the encoded polypeptide; and a sample contacted with an antibody not specific for the encoded polypeptide, e.g., an anti-idiotype antibody. A variety of methods to detect specific antibody-antigen interactions are known in the art and can be used in the method, including, but not limited to, standard immunohistological methods, immunoprecipitation, an enzyme immunoassay, and a radioimmunoassay.

In general, the specific antibody will be detectably labeled, either directly or indirectly. Direct labels include radioisotopes; enzymes whose products are detectable (e.g., luciferase, β-galactosidase, and the like); fluorescent labels (e.g., fluorescein isothiocyanate, rhodamine, phycoerythrin, and the like); fluorescence emitting metals, e.g., $^{152}$Eu, or others of the lanthanide series, attached to the antibody through metal chelating groups such as EDTA; chemiluminescent compounds, e.g., luminol, isoluminol, acridinium salts, and the like; bioluminescent compounds, e.g., luciferin, aequorin (green fluorescent protein), and the like.

The antibody may be attached (coupled) to an insoluble support, such as a polystyrene plate or a bead. Indirect labels include second antibodies specific for antibodies specific for the encoded polypeptide ("first specific antibody"), wherein the second antibody is labeled as described above; and members of specific binding pairs, e.g., biotin-avidin, and the like. The biological sample may be brought into contact with and immobilized on a solid support or carrier, such as nitrocellulose, that is capable of immobilizing cells, cell particles, or soluble proteins. The support may then be washed with suitable buffers, followed by contacting with a detectably-labeled first specific antibody. Detection methods are known in the art and will be chosen as appropriate to the signal emitted by the detectable label. Detection is generally accomplished in comparison to suitable controls, and to appropriate standards.

In some embodiments, the methods are adapted for use in vivo, e.g., to locate or identify sites where cancer cells are present. In these embodiments, a detectably-labeled moiety, e.g., an antibody, which is specific for a cancer-associated polypeptide is administered to an individual (e.g., by injection), and labeled cells are located using standard imaging techniques, including, but not limited to, magnetic resonance imaging, computed tomography scanning, and the like. In this manner, cancer cells are differentially labeled.

Detecting a Polynucleotide that Represents a Gene Differentially Expressed in a Cancer Cell In some embodiments, methods are provided for detecting a cancer cell by detecting expression in the cell of a transcript or that is differentially expressed in a cancer cell. Any of a variety of known methods can be used for detection, including, but not limited to, detection of a transcript by hybridization with a polynucleotide that hybridizes to a polynucleotide that is differentially expressed in a cancer cell; detection of a transcript by a polymerase chain reaction using specific oligonucleotide primers; in situ hybridization of a cell using as a probe a polynucleotide that hybridizes to a gene that is differentially expressed in a cancer cell and the like.

In many embodiments, the levels of a subject gene product are measured. By measured is meant qualitatively or quantitatively estimating the level of the gene product in a first biological sample either directly (e.g. by determining or estimating absolute levels of gene product) or relatively by comparing the levels to a second control biological sample. In many embodiments the second control biological sample is obtained from an individual not having not having cancer. As will be appreciated in the art, once a standard control level of gene expression is known, it can be used repeatedly as a standard for comparison. Other control samples include samples of cancerous tissue.

The methods can be used to detect and/or measure mRNA levels of a gene that is differentially expressed in a cancer cell. In some embodiments, the methods comprise: a) contacting a sample with a polynucleotide that corresponds to a differentially expressed gene described herein under conditions that allow hybridization; and b) detecting hybridization, if any. Detection of differential hybridization, when compared to a suitable control, is an indication of the presence in the sample of a polynucleotide that is differentially expressed in a cancer cell. Appropriate controls include, for example, a sample that is known not to contain a polynucleotide that is differentially expressed in a cancer cell. Conditions that allow hybridization are known in the art, and have been described in more detail above.

Detection can also be accomplished by any known method, including, but not limited to, in situ hybridization, PCR (polymerase chain reaction), RT-PCR (reverse transcription-PCR), and "Northern" or RNA blotting, arrays, microarrays, etc, or combinations of such techniques, using a suitably labeled polynucleotide. A variety of labels and labeling methods for polynucleotides are known in the art and can be used in the assay methods of the invention. Specific hybridization can be determined by comparison to appropriate controls.

Polynucleotides described herein are used for a variety of purposes, such as probes for detection of and/or measurement of, transcription levels of a polynucleotide that is differentially expressed in a cancer cell. Additional disclosure about preferred regions of the disclosed polynucleotide sequences is found in the Examples. A probe that hybridizes specifically to a polynucleotide disclosed herein should provide a detection signal at least 2-, 5-, 10-, or 20-fold higher than the background hybridization provided with other unrelated sequences. It should be noted that "probe" as used in this context of detection of nucleic acid is meant to refer to a polynucleotide sequence used to detect a differentially expressed gene product in a test sample. As will be readily appreciated by the ordinarily skilled artisan, the probe can be detectably labeled and contacted with, for example, an array comprising immobilized polynucleotides obtained from a test sample (e.g., mRNA). Alternatively, the probe can be immobilized on an array and the test sample detectably labeled. These and other variations of the methods of the invention are well within the skill in the art and are within the scope of the invention.

Labeled nucleic acid probes may be used to detect expression of a gene corresponding to the provided polynucleotide. In Northern blots, mRNA is separated electrophoretically and contacted with a probe. A probe is detected as hybridizing to an mRNA species of a particular size. The amount of hybridization can be quantitated to determine relative amounts of expression, for example under a particular condition. Probes are used for in situ hybridization to cells to detect expression. Probes can also be used in vivo for diagnostic detection of hybridizing sequences. Probes are typically labeled with a radioactive isotope. Other types of detectable labels can be used such as chromophores, fluorophores, and enzymes. Other examples of nucleotide hybridization assays are described in WO092/02526 and U.S. Pat. No. 5,124,246.

PCR is another means for detecting small amounts of target nucleic acids, methods for which may be found in Sambrook, et al. *Molecular Cloning: A Laboratory Manual*, CSH Press 1989, pp. 14.2-14.33.

A detectable label may be included in the amplification reaction. Suitable detectable labels include fluorochromes, (e.g. fluorescein isothiocyanate (FITC), rhodamine, Texas Red, phycoerythrin, allophycocyanin, 6-carboxyfluorescein (6-FAM), 2', 7'-dimethoxy-4',5'-dichloro-6-carboxyfluorescein, 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA)), radioactive labels, (e.g. $^{32}P$, $^{35}S$, $^{3}H$, etc.), and the like. The label may be a two stage system, where the polynucleotides is conjugated to biotin, haptens, etc. having a high affinity binding partner, e.g. avidin, specific antibodies, etc., where the binding partner is conjugated to a detectable label. The label may be conjugated to one or both of the primers. Alternatively, the pool of nucleotides used in the amplification is labeled, so as to incorporate the label into the amplification product.

Arrays

Polynucleotide arrays provide a high throughput technique that can assay a large number of polynucleotides or polypeptides in a sample. This technology can be used as a tool to test for differential expression.

A variety of methods of producing arrays, as well as variations of these methods, are known in the art and contemplated for use in the invention. For example, arrays can be created by spotting polynucleotide probes onto a substrate (e.g., glass, nitrocellulose, etc.) in a two-dimensional matrix or array having bound probes. The probes can be bound to the substrate by either covalent bonds or by non-specific interactions, such as hydrophobic interactions.

Samples of polynucleotides can be detectably labeled (e.g., using radioactive or fluorescent labels) and then hybridized to the probes. Double stranded polynucleotides, comprising the labeled sample polynucleotides bound to probe polynucleotides, can be detected once the unbound portion of the sample is washed away. Alternatively, the polynucleotides of the test sample can be immobilized on the array, and the probes detectably labeled. Techniques for constructing arrays and methods of using these arrays are described in, for example, Schena et al. (1996) *Proc Natl Acad Sci* USA. 93(20):10614-9; Schena et al. (1995) *Science* 270(5235):467-70; Shalon et al. (1996) *Genome Res.* 6(7): 639-45, U.S. Pat. No. 5,807,522, EP 799 897; WO 97/29212; WO 97/27317; EP 785 280; WO 97/02357; U.S. Pat. No. 5,593,839; U.S. Pat. No. 5,578,832; EP 728 520; U.S. Pat. No. 5,599,695; EP 721 016; U.S. Pat. No. 5,556,752; WO 95/22058; and U.S. Pat. No. 5,631,734. In most embodiments, the "probe" is detectably labeled. In other embodiments, the probe is immobilized on the array and not detectably labeled.

Arrays can be used, for example, to examine differential expression of genes and can be used to determine gene function. For example, arrays can be used to detect differential expression of a gene corresponding to a polynucleotide described herein, where expression is compared between a test cell and control cell (e.g., cancer cells and normal cells). For example, high expression of a particular message in a cancer cell, which is not observed in a corresponding normal cell, can indicate a cancer specific gene product. Exemplary uses of arrays are further described in, for example, Pappalarado et al., *Sem. Radiation Oncol.* (1998) 8:217; and Ramsay, *Nature Biotechnol.* (1998) 16:40. Furthermore, many variations on methods of detection using arrays are well within the skill in the art and within the scope of the present invention. For example, rather than immobilizing the probe to a solid support, the test sample can be immobilized on a solid support which is then contacted with the probe.

Diagnosis, Prognosis, Assessment of Therapy (Therametrics), and Management of Cancer The polynucleotides described herein, as well as their gene products and corresponding genes and gene products, are of particular interest as genetic or biochemical markers (e.g., in blood or tissues) that will detect the earliest changes along the carcinogenesis pathway and/or to monitor the efficacy of various therapies and preventive interventions.

For example, the level of expression of certain polynucleotides can be indicative of a poorer prognosis, and therefore warrant more aggressive chemo- or radio-therapy for a patient or vice versa. The correlation of novel surrogate tumor specific features with response to treatment and outcome in patients can define prognostic indicators that allow the design of tailored therapy based on the molecular profile of the tumor. These therapies include antibody targeting, antagonists (e.g., small molecules), and gene therapy.

Determining expression of certain polynucleotides and comparison of a patient's profile with known expression in normal tissue and variants of the disease allows a determination of the best possible treatment for a patient, both in terms of specificity of treatment and in terms of comfort level of the patient. Surrogate tumor markers, such as polynucleotide expression, can also be used to better classify, and thus diagnose and treat, different forms and disease states of cancer. Two classifications widely used in oncology that can benefit from identification of the expression levels of the genes corresponding to the polynucleotides described herein are staging of the cancerous disorder, and grading the nature of the cancerous tissue.

The polynucleotides that correspond to differentially expressed genes, as well as their encoded gene products, can be useful to monitor patients having or susceptible to cancer to detect potentially malignant events at a molecular level before they are detectable at a gross morphological level. In addition, the polynucleotides described herein, as well as the genes corresponding to such polynucleotides, can be useful as therametrics, e.g., to assess the effectiveness of therapy by using the polynucleotides or their encoded gene products, to assess, for example, tumor burden in the patient before, during, and after therapy.

Furthermore, a polynucleotide identified as corresponding to a gene that is differentially expressed in, and thus is important for, one type of cancer can also have implications for development or risk of development of other types of cancer, e.g., where a polynucleotide represents a gene differentially expressed across various cancer types. Thus, for example, expression of a polynucleotide corresponding to a gene that has clinical implications for cancer can also have clinical implications for metastatic breast cancer, colon cancer, or ovarian cancer, etc.

Staging. Staging is a process used by physicians to describe how advanced the cancerous state is in a patient. Staging assists the physician in determining a prognosis, planning treatment and evaluating the results of such treatment. Staging systems vary with the types of cancer, but generally involve the following "TNM" system: the type of tumor, indicated by T; whether the cancer has metastasized to nearby lymph nodes, indicated by N; and whether the cancer has metastasized to more distant parts of the body, indicated by M. Generally, if a cancer is only detectable in the area of the primary lesion without having spread to any lymph nodes it is called Stage I. If it has spread only to the closest lymph nodes, it is called Stage II. In Stage III, the cancer has generally spread to the lymph nodes in near proximity to the site of the primary lesion. Cancers that have spread to a distant part of the body, such as the liver, bone, brain or other site, are Stage IV, the most advanced stage.

The polynucleotides and corresponding genes and gene products described herein can facilitate fine-tuning of the staging process by identifying markers for the aggressiveness of a cancer, e.g. the metastatic potential, as well as the presence in different areas of the body. Thus, a Stage II cancer with a polynucleotide signifying a high metastatic potential cancer can be used to change a borderline Stage II tumor to a Stage III tumor, justifying more aggressive therapy. Conversely, the presence of a polynucleotide signifying a lower metastatic potential allows more conservative staging of a tumor.

One type of breast cancer is ductal carcinoma in situ (DCIS): DCIS is when the breast cancer cells are completely contained within the breast ducts (the channels in the breast that carry milk to the nipple), and have not spread into the surrounding breast tissue. This may also be referred to as non-invasive or intraductal cancer, as the cancer cells have not yet spread into the surrounding breast tissue and so usually have not spread into any other part of the body.

Lobular carcinoma in situ breast cancer (LCIS) means that cell changes are found in the lining of the lobules of the breast. It can be present in both breasts. It is also referred to as non-invasive cancer as it has not spread into the surrounding breast tissue.

Invasive breast cancer can be staged as follows: Stage 1 tumours: these measure less than two centimetres. The lymph glands in the armpit are not affected and there are no signs that the cancer has spread elsewhere in the body; Stage 2 tumours: these measure between two and five centimetres, or the lymph glands in the armpit are affected, or both. However, there are no signs that the cancer has spread further; Stage 3 tumours: these are larger than five centimetres and may be attached to surrounding structures such as the muscle or skin. The lymph glands are usually affected, but there are no signs that the cancer has spread beyond the breast or the lymph glands in the armpit; Stage 4 tumours: these are of any size, but the lymph glands are usually affected and the cancer has spread to other parts of the body. This is secondary breast cancer.

Grading of cancers. Grade is a term used to describe how closely a tumor resembles normal tissue of its same type. The microscopic appearance of a tumor is used to identify tumor grade based on parameters such as cell morphology, cellular organization, and other markers of differentiation. As a general rule, the grade of a tumor corresponds to its rate of growth or aggressiveness, with undifferentiated or high-grade tumors generally being more aggressive than well-differentiated or low-grade tumors.

The polynucleotides of the Sequence Listing, and their corresponding genes and gene products, can be especially valuable in determining the grade of the tumor, as they not only can aid in determining the differentiation status of the cells of a tumor, they can also identify factors other than differentiation that are valuable in determining the aggressiveness of a tumor, such as metastatic potential.

Low grade means that the cancer cells look very like the normal cells. They are usually slowly growing and are less likely to spread. In high grade tumors the cells look very abnormal. They are likely to grow more quickly and are more likely to spread.

Assessment of proliferation of cells in tumor. The differential expression level of the polynucleotides described herein can facilitate assessment of the rate of proliferation of tumor cells, and thus provide an indicator of the aggressiveness of the rate of tumor growth. For example, assessment of the relative expression levels of genes involved in cell cycle can provide an indication of cellular proliferation, and thus serve as a marker of proliferation.

Detection of Cancer.

The polynucleotides corresponding to genes that exhibit the appropriate expression pattern can be used to detect cancer in a subject. The expression of appropriate polynucleotides can be used in the diagnosis, prognosis and management of cancer. Detection of cancer can be determined using expression levels of any of these sequences alone or in combination with the levels of expression of other known cancer genes. Determination of the aggressive nature and/or the metastatic potential of a cancer can be determined by comparing levels of one or more gene products of the genes corresponding to the polynucleotides described herein, and comparing total levels of another sequence known to vary in cancerous tissue, e.g., expression of p53, DCC, ras, FAP (see, e.g., Fearon E R, et al., *Cell* (1990) 61(5):759; Hamilton S R et al., *Cancer* (1993) 72:957; Bodmer W, et al., *Nat Genet.* (1994) 4(3):217; Fearon E R, *Ann N Y Acad Sci.* (1995) 768:101). For example, development of cancer can be detected by examining the level of expression of a gene corresponding to a polynucleotides described herein to the levels of oncogenes (e.g. ras) or tumor suppressor genes (e.g. FAP or p53). Thus expression of specific marker polynucleotides can be used to discriminate between normal and cancerous tissue, to discriminate between cancers with different cells of origin, to discriminate between cancers with different potential metastatic rates, etc. For a review of other markers of cancer, see, e.g., Hanahan et al. (2000) Cell 100:57-70.

Treatment of Cancer

The invention further provides methods for reducing growth of cancer cells. The methods provide for decreasing the expression of a gene that is differentially expressed in a cancer cell or decreasing the level of and/or decreasing an activity of a cancer-associated polypeptide. In general, the methods comprise contacting a cancer cell with a substance that modulates (1) expression of a gene that is differentially expressed in cancer; or (2) a level of and/or an activity of a cancer-associated polypeptide.

"Reducing growth of cancer cells" includes, but is not limited to, reducing proliferation of cancer cells, and reducing the incidence of a non-cancerous cell becoming a cancerous cell. Whether a reduction in cancer cell growth has been achieved can be readily determined using any known assay, including, but not limited to, [$^3$H]-thymidine incorporation; counting cell number over a period of time; detecting and/or measuring a marker associated with breast cancer (e.g., PSA).

The present invention provides methods for treating cancer, generally comprising administering to an individual in need thereof a substance that reduces cancer cell growth, in an amount sufficient to reduce cancer cell growth and treat the cancer. Whether a substance, or a specific amount of the substance, is effective in treating cancer can be assessed using any of a variety of known diagnostic assays for cancer, including, but not limited to, proctoscopy, rectal examination, biopsy, contrast radiographic studies, CAT scan, and detection of a tumor marker associated with cancer in the blood of the individual (e.g., PSA (breast-specific antigen)). The substance can be administered systemically or locally. Thus, in some embodiments, the substance is administered locally, and cancer growth is decreased at the site of administration. Local administration may be useful in treating, e.g., a solid tumor.

A substance that reduces cancer cell growth can be targeted to a cancer cell. Thus, in some embodiments, the invention provides a method of delivering a drug to a cancer cell, comprising administering a drug-antibody complex to a subject, wherein the antibody is specific for a cancer-associated polypeptide, and the drug is one that reduces cancer cell growth, a variety of which are known in the art. Targeting can be accomplished by coupling (e.g., linking, directly or via a linker molecule, either covalently or non-covalently, so as to form a drug-antibody complex) a drug to an antibody specific for a cancer-associated polypeptide. Methods of coupling a drug to an antibody are well known in the art and need not be elaborated upon herein.

Tumor Classification and Patient Stratification

The invention further provides for methods of classifying tumors, and thus grouping or "stratifying" patients, according to the expression profile of selected differentially expressed genes in a tumor. Differentially expressed genes can be analyzed for correlation with other differentially expressed genes in a single tumor type or across tumor types. Genes that demonstrate consistent correlation in expression profile in a given cancer cell type (e.g., in a cancer cell or type of cancer) can be grouped together, e.g., when one gene is overexpressed in a tumor, a second gene is also usually overexpressed. Tumors can then be classified according to the expression profile of one or more genes selected from one or more groups.

The tumor of each patient in a pool of potential patients can be classified as described above. Patients having similarly classified tumors can then be selected for participation in an investigative or clinical trial of a cancer therapeutic where a homogeneous population is desired. The tumor classification of a patient can also be used in assessing the efficacy of a cancer therapeutic in a heterogeneous patient population. In addition, therapy for a patient having a tumor of a given expression profile can then be selected accordingly.

In another embodiment, differentially expressed gene products (e.g., polypeptides or polynucleotides encoding such polypeptides) may be effectively used in treatment through vaccination. The growth of cancer cells is naturally limited in part due to immune surveillance. Stimulation of the immune system using a particular tumor-specific antigen enhances the effect towards the tumor expressing the antigen. An active vaccine comprising a polypeptide encoded by the cDNA of this invention would be appropriately administered to subjects having an alteration, e.g., overabundance, of the corresponding. RNA, or those predisposed for developing cancer cells with an alteration of the same RNA. Polypeptide antigens are typically combined with an adjuvant as part of a vaccine composition. The vaccine is preferably administered first as a priming dose, and then again as a boosting dose, usually at least four weeks later. Further boosting doses may be given to enhance the effect. The dose and its timing are usually determined by the person responsible for the treatment.

The invention also encompasses the selection of a therapeutic regimen based upon the expression profile of differentially expressed genes in the patient's tumor. For example, a tumor can be analyzed for its expression profile of the genes corresponding to SEQ ID NOS: 1-13996 as described herein, e.g., the tumor is analyzed to determine which genes are expressed at elevated levels or at decreased levels relative to normal cells of the same tissue type. The expression patterns of the tumor are then compared to the expression patterns of tumors that respond to a selected therapy. Where the expression profiles of the test tumor cell and the expression profile of a tumor cell of known drug responsivity at least substantially match (e.g., selected sets of genes at elevated levels in the tumor of known drug responsivity and are also at elevated levels in the test tumor cell), then the therapeutic agent selected for therapy is the drug to which tumors with that expression pattern respond.

Pattern Matching in Diagnosis Using Arrays

In another embodiment, the diagnostic and/or prognostic methods of the invention involve detection of expression of a selected set of genes in a test sample to produce a test expression pattern (TEP). The TEP is compared to a reference expression pattern (REP), which is generated by detection of expression of the selected set of genes in a reference sample (e.g., a positive or negative control sample). The selected set of genes includes at least one of the genes of the invention, which genes correspond to the polynucleotide sequences described herein. Of particular interest is a selected set of genes that includes gene differentially expressed in the disease for which the test sample is to be screened.

Identification of Therapeutic Targets and Anti-Cancer Therapeutic Agents

The present invention also encompasses methods for identification of agents having the ability to modulate activity of a differentially expressed gene product, as well as methods for identifying a differentially expressed gene product as a therapeutic target for treatment of cancer.

Identification of compounds that modulate activity of a differentially expressed gene product can be accomplished using any of a variety of drug screening techniques. Such agents are candidates for development of cancer therapies. Of particular interest are screening assays for agents that have tolerable toxicity for normal, non-cancerous human cells. The screening assays of the invention are generally based upon the ability of the agent to modulate an activity of a differentially expressed gene product and/or to inhibit or suppress phenomenon associated with cancer (e.g. cell proliferation, colony formation, cell cycle arrest, metastasis, and the like).

Screening of Candidate Agents

Screening assays can be based upon any of a variety of techniques readily available and known to one of ordinary skill in the art. In general, the screening assays involve contacting a cancerous cell with a candidate agent, and assessing the effect upon biological activity of a differentially expressed gene product. The effect upon a biological activity can be detected by, for example, detection of expression of a gene product of a differentially expressed gene (e.g., a decrease in mRNA or polypeptide levels, would in turn cause a decrease in biological activity of the gene product). Alternatively or in addition, the effect of the candidate agent can be assessed by examining the effect of the candidate agent in a functional assay. For example, where the differentially expressed gene product is an enzyme, then the effect upon biological activity can be assessed by detecting a level of enzymatic activity associated with the differentially expressed gene product. The functional assay will be selected according to the differentially expressed gene product. In general, where the differentially expressed gene is increased in expression in a cancerous cell, agents of interest are those that decrease activity of the differentially expressed gene product.

Assays described infra can be readily adapted in the screening assay embodiments of the invention. Exemplary assays useful in screening candidate agents include, but are not limited to, hybridization-based assays (e.g., use of nucleic acid probes or primers to assess expression levels), antibody-based assays (e.g., to assess levels of polypeptide gene products), binding assays (e.g., to detect interaction of a candidate agent with a differentially expressed polypeptide, which assays may be competitive assays where a natural or synthetic ligand for the polypeptide is available), and the like. Additional exemplary assays include, but are not necessarily limited to, cell proliferation assays, antisense knockout assays, assays to detect inhibition of cell cycle, assays of induction of cell death/apoptosis, and the like. Generally such assays are conducted in vitro, but many assays can be adapted for in vivo analyses, e.g., in an animal model of the cancer.

Identification of Therapeutic Targets

In another embodiment, the invention contemplates identification of differentially expressed genes and gene products as therapeutic targets. In some respects, this is the converse of the assays described above for identification of agents having activity in modulating (e.g., decreasing or increasing) activity of a differentially expressed gene product.

In this embodiment, therapeutic targets are identified by examining the effect(s) of an agent that can be demonstrated or has been demonstrated to modulate a cancerous phenotype (e.g., inhibit or suppress or prevent development of a cancerous phenotype). Such agents are generally referred to herein as an "anti-cancer agent", which agents encompass chemotherapeutic agents. For example, the agent can be an antisense oligonucleotide that is specific for a selected gene transcript. For example, the antisense oligonucleotide may have a sequence corresponding to a sequence of a differentially expressed gene described herein, e.g., a sequence of one of SEQ ID NOS: 1-13996.

Assays for identification of therapeutic targets can be conducted in a variety of ways using methods that are well known to one of ordinary skill in the art. For example, a test cancerous cell that expresses or overexpresses a differentially expressed gene is contacted with an anti-cancer agent, the effect upon a cancerous phenotype and a biological activity of the candidate gene product assessed. The biological activity of the candidate gene product can be assayed be examining, for example, modulation of expression of a gene encoding the candidate gene product (e.g., as detected by, for example, an increase or decrease in transcript levels or polypeptide levels), or modulation of an enzymatic or other activity of the gene product. The cancerous phenotype can be, for example, cellular proliferation, loss of contact inhibition of growth (e.g., colony formation), tumor growth (in vitro or in vivo), and the like. Alternatively or in addition, the effect of modulation of a biological activity of the candidate target gene upon cell death/apoptosis or cell cycle regulation can be assessed.

Inhibition or suppression of a cancerous phenotype, or an increase in cell death or apoptosis as a result of modulation of biological activity of a candidate gene product indicates that the candidate gene product is a suitable target for cancer therapy. Assays described infra can be readily adapted for assays for identification of therapeutic targets. Generally such assays are conducted in vitro, but many assays can be adapted for in vivo analyses, e.g., in an appropriate, art-accepted animal model of the cancer.

Candidate Agents

The term "agent" as used herein describes any molecule, e.g. protein or pharmaceutical, with the capability of modulating a biological activity of a gene product of a differentially expressed gene. Generally a plurality of assay mixtures are run in parallel with different agent concentrations to obtain a differential response to the various concentrations. Typically, one of these concentrations serves as a negative control, i.e. at zero concentration or below the level of detection.

Candidate agents encompass numerous chemical classes, though typically they are organic molecules, preferably small organic compounds having a molecular weight of more than 50 and less than about 2,500 daltons. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Candidate agents are also found among biomolecules including, but not limited to: peptides, saccharides, fatty acids, steroids, purines, pyrimidines, derivatives, structural analogs or combinations thereof.

Candidate agents are obtained from a wide variety of sources including libraries of synthetic or natural compounds. For example, numerous means are available for random and directed synthesis of a wide variety of organic compounds and biomolecules, including expression of randomized oligonucleotides and oligopeptides. Alternatively, libraries of natural compounds in the form of bacterial, fungal, plant and animal extracts (including extracts from human tissue to identify endogenous factors affecting differentially expressed gene products) are available or readily produced. Additionally, natural or synthetically produced libraries and compounds are readily modified through conventional chemical, physical and biochemical means, and may be used to produce combinatorial libraries. Known pharmacological agents may be subjected to directed or random chemical modifications, such as acylation, alkylation, esterification, amidification, etc. to produce structural analogs.

Exemplary candidate agents of particular interest include, but are not limited to, antisense and RNAi polynucleotides, and antibodies, soluble receptors, and the like. Antibodies and soluble receptors are of particular interest as candidate agents where the target differentially expressed gene product is secreted or accessible at the cell-surface (e.g., receptors and other molecule stably-associated with the outer cell membrane).

For method that involve RNAi (RNA interference), a double stranded RNA (dsRNA) molecule is usually used. The dsRNA is prepared to be substantially identical to at least a segment of a subject polynucleotide (e.g. a cDNA or gene). In general, the dsRNA is selected to have at least 70%, 75%, 80%, 85% or 90% sequence identity with the subject polynucleotide over at least a segment of the candidate gene. In other instances, the sequence identity is even higher, such as 95%, 97% or 99%, and in still other instances, there is 100% sequence identity with the subject polynucleotide over at least a segment of the subject polynucleotide. The size of the segment over which there is sequence identity can vary depending upon the size of the subject polynucleotide. In general, however, there is substantial sequence identity over at least 15, 20, 25, 30, 35, 40 or 50 nucleotides. In other instances, there is substantial sequence identity over at least 100, 200, 300, 400, 500 or 1000 nucleotides; in still other instances, there is substantial sequence identity over the entire length of the subject polynucleotide, i.e., the coding and non-coding region of the candidate gene.

Because only substantial sequence similarity between the subject polynucleotide and the dsRNA is necessary, sequence variations between these two species arising from genetic mutations, evolutionary divergence and polymorphisms can be tolerated. Moreover, as described further infra, the dsRNA can include various modified or nucleotide analogs.

Usually the dsRNA consists of two separate complementary RNA strands. However, in some instances, the dsRNA may be formed by a single strand of RNA that is self-complementary, such that the strand loops back upon itself to form a hairpin loop. Regardless of form, RNA duplex formation can occur inside or outside of a cell.

The size of the dsRNA that is utilized varies according to the size of the subject polynucleotide whose expression is to be suppressed and is sufficiently long to be effective in reducing expression of the subject polynucleotide in a cell. Generally, the dsRNA is at least 10-15 nucleotides long. In certain applications, the dsRNA is less than 20, 21, 22, 23, 24 or 25 nucleotides in length. In other instances, the dsRNA is at least 50, 100, 150 or 200 nucleotides in length. The dsRNA can be longer still in certain other applications, such as at least 300, 400, 500 or 600 nucleotides. Typically, the dsRNA is not longer than 3000 nucleotides. The optimal size for any particular subject polynucleotide can be determined by one of ordinary skill in the art without undue experimentation by varying the size of the dsRNA in a systematic fashion and determining whether the size selected is effective in interfering with expression of the subject polynucleotide.

dsRNA can be prepared according to any of a number of methods that are known in the art, including in vitro and in vivo methods, as well as by synthetic chemistry approaches.

In vitro methods. Certain methods generally involve inserting the segment corresponding to the candidate gene that is to be transcribed between a promoter or pair of promoters that are oriented to drive transcription of the inserted segment and then utilizing an appropriate RNA polymerase to carry out transcription. One such arrangement involves positioning a DNA fragment corresponding to the candidate gene or segment thereof into a vector such that it is flanked by two opposable polymerase-specific promoters that can be same or different. Transcription from such promoters produces two complementary RNA strands that can subsequently anneal to form the desired dsRNA. Exemplary plasmids for use in such systems include the plasmid (PCR 4.0 TOPO) (available from Invitrogen). Another example is the vector pGEM-T (Promega, Madison, Wis.) in which the oppositely oriented promoters are T7 and SP6; the T3 promoter can also be utilized.

In a second arrangement, DNA fragments corresponding to the segment of the subject polynucleotide that is to be transcribed is inserted both in the sense and antisense orientation downstream of a single promoter. In this system, the sense and antisense fragments are cotranscribed to generate a single RNA strand that is self-complementary and thus can form dsRNA.

Various other in vitro methods have been described. Examples of such methods include, but are not limited to, the methods described by Sadher et al. (Biochem. Int. 14:1015, 1987); by Bhattacharyya (Nature 343:484, 1990); and by Livache, et al. (U.S. Pat. No. 5,795,715), each of which is incorporated herein by reference in its entirety.

Single-stranded RNA can also be produced using a combination of enzymatic and organic synthesis or by total organic synthesis. The use of synthetic chemical methods enable one to introduce desired modified nucleotides or nucleotide analogs into the dsRNA.

In vivo methods. dsRNA can also be prepared in vivo according to a number of established methods (see, e.g., Sambrook, et al. (1989) Molecular Cloning: A Laboratory Manual, $2^{nd}$ ed.; Transcription and Translation (B. D. Hames, and S. J. Higgins, Eds., 1984); DNA Cloning, volumes I and II (D. N. Glover, Ed., 1985); and Oligonucleotide Synthesis (M. J. Gait, Ed., 1984, each of which is incorporated herein by reference in its entirety).

Once the single-stranded RNA has been formed, the complementary strands are allowed to anneal to form duplex RNA. Transcripts are typically treated with DNAase and further purified according to established protocols to remove proteins. Usually such purification methods are not conducted with phenol:chloroform. The resulting purified transcripts are subsequently dissolved in RNAase free water or a buffer of suitable composition.

dsRNA is generated by annealing the sense and anti-sense RNA in vitro. Generally, the strands are initially denatured to keep the strands separate and to avoid self-annealing. During the annealing process, typically certain ratios of the sense and antisense strands are combined to facilitate the annealing process. In some instances, a molar ratio of sense to antisense strands of 3:7 is used; in other instances, a ratio of 4:6 is utilized; and in still other instances, the ratio is 1:1.

The buffer composition utilized during the annealing process can in some instances affect the efficacy of the annealing process and subsequent transfection procedure. While some have indicated that the buffered solution used to carry out the annealing process should include a potassium salt such as potassium chloride (e.g. at a concentration of about 80 mM). In some embodiments, the buffer is substantially potassium free. Once single-stranded RNA has annealed to form duplex RNA, typically any single-strand overhangs are removed using an enzyme that specifically cleaves such overhangs (e.g., RNAase A or RNAase T).

Once the dsRNA has been formed, it is introduced into a reference cell, which can include an individual cell or a population of cells (e.g., a tissue, an embryo and an entire organism). The cell can be from essentially any source, including animal, plant, viral, bacterial, fungal and other sources. If a tissue, the tissue can include dividing or nondividing and differentiated or undifferentiated cells. Further, the tissue can include germ line cells and somatic cells. Examples of differentiated cells that can be utilized include, but are not limited to, neurons, glial cells, blood cells, megakaryocytes, lymphocytes, macrophages, neutrophils, eosinophils, basophils, mast cells, leukocytes, granulocytes, keratinocytes, adipocytes, osteoblasts, osteoclasts, hepatocytes, cells of the endocrine or exocrine glands, fibroblasts, myocytes, cardiomyocytes, and endothelial cells. The cell can be an individual cell of an embryo, and can be a blastocyte or an oocyte.

Certain methods are conducted using model systems for particular cellular states (e.g., a disease). For instance, certain methods provided herein are conducted with a cancer cell lines that serves as a model system for investigating genes that are correlated with various cancers.

A number of options can be utilized to deliver the dsRNA into a cell or population of cells such as in a cell culture, tissue or embryo. For instance, RNA can be directly introduced intracellularly. Various physical methods are generally utilized in such instances, such as administration by microinjection (see, e.g., Zernicka-Goetz, et al. (1997) Development 124:1133-1137; and Wianny, et al. (1998) Chromosoma 107: 430-439).

Other options for cellular delivery include permeabilizing the cell membrane and electroporation in the presence of the dsRNA, liposome-mediated transfection, or transfection using chemicals such as calcium phosphate. A number of established gene therapy techniques can also be utilized to introduce the dsRNA into a cell. By introducing a viral construct within a viral particle, for instance, one can achieve efficient introduction of an expression construct into the cell and transcription of the RNA encoded by the construct.

If the dsRNA is to be introduced into an organism or tissue, gene gun technology is an option that can be employed. This generally involves immobilizing the dsRNA on a gold particle which is subsequently fired into the desired tissue. Research has also shown that mammalian cells have transport mechanisms for taking in dsRNA (see, e.g., Asher, et al. (1969) Nature 223:715-717). Consequently, another delivery option is to administer the dsRNA extracellularly into a body cavity, interstitial space or into the blood system of the mammal for subsequent uptake by such transport processes. The blood and lymph systems and the cerebrospinal fluid are potential sites for injecting dsRNA. Oral, topical, parenteral, rectal and intraperitoneal administration are also possible modes of administration.

The composition introduced can also include various other agents in addition to the dsRNA. Examples of such agents include, but are not limited to, those that stabilize the dsRNA, enhance cellular uptake and/or increase the extent of interference. Typically, the dsRNA is introduced in a buffer that is compatible with the composition of the cell into which the RNA is introduced to prevent the cell from being shocked. The minimum size of the dsRNA that effectively achieves gene silencing can also influence the choice of delivery system and solution composition.

Sufficient dsRNA is introduced into the tissue to cause a detectable change in expression of a target gene (assuming the candidate gene is in fact being expressed in the cell into which the dsRNA is introduced) using available detection methodologies. Thus, in some instances, sufficient dsRNA is introduced to achieve at least a 5-10% reduction in candidate gene expression as compared to a cell in which the dsRNA is not introduced. In other instances, inhibition is at least 20, 30, 40 or 50%. In still other instances, the inhibition is at least 60, 70, 80, 90 or 95%. Expression in some instances is essentially completely inhibited to undetectable levels.

The amount of dsRNA introduced depends upon various factors such as the mode of administration utilized, the size of the dsRNA, the number of cells into which dsRNA is administered, and the age and size of an animal if dsRNA is introduced into an animal. An appropriate amount can be determined by those of ordinary skill in the art by initially administering dsRNA at several different concentrations for example, for example. In certain instances when dsRNA is introduced into a cell culture, the amount of dsRNA introduced into the cells varies from about 0.5 to 3 μg per $10^6$ cells.

A number of options are available to detect interference of candidate gene expression (i.e., to detect candidate gene silencing). In general, inhibition in expression is detected by detecting a decrease in the level of the protein encoded by the candidate gene, determining the level of mRNA transcribed from the gene and/or detecting a change in phenotype associated with candidate gene expression.

Use of Polypeptides to Screen for Peptide Analogs and Antagonists

Polypeptides encoded by differentially expressed genes identified herein can be used to screen peptide libraries to identify binding partners, such as receptors, from among the encoded polypeptides. Peptide libraries can be synthesized according to methods known in the art (see, e.g., U.S. Pat. No. 5,010,175 and WO 91/17823).

Agonists or antagonists of the polypeptides of the invention can be screened using any available method known in the art, such as signal transduction, antibody binding, receptor binding, mitogenic assays, chemotaxis assays, etc. The assay conditions ideally should resemble the conditions under which the native activity is exhibited in vivo, that is, under physiologic pH, temperature, and ionic strength. Suitable agonists or antagonists will exhibit strong inhibition or enhancement of the native activity at concentrations that do not cause toxic side effects in the subject. Agonists or antagonists that compete for binding to the native polypeptide can require concentrations equal to or greater than the native concentration, while inhibitors capable of binding irreversibly to the polypeptide can be added in concentrations on the order of the native concentration.

Such screening and experimentation can lead to identification of a polypeptide binding partner, such as a receptor, encoded by a gene or a cDNA corresponding to a polynucleotide described herein, and at least one peptide agonist or antagonist of the binding partner. Such agonists and antagonists can be used to modulate, enhance, or inhibit receptor function in cells to which the receptor is native, or in cells that possess the receptor as a result of genetic engineering. Further, if the receptor shares biologically important characteristics with a known receptor, information about agonist/antagonist binding can facilitate development of improved agonists/antagonists of the known receptor.

Vaccines and Uses

The differentially expressed nucleic acids and polypeptides produced by the nucleic acids of the invention can also be used to modulate primary immune response to prevent or treat cancer. Every immune response is a complex and intricately regulated sequence of events involving several cell types. It is triggered when an antigen enters the body and encounters a specialized class of cells called antigen-presenting cells (APCs). These APCs capture a minute amount of the antigen and display it in a form that can be recognized by antigen-specific helper T lymphocytes. The helper (Th) cells become activated and, in turn, promote the activation of other classes of lymphocytes, such as B cells or cytotoxic T cells. The activated lymphocytes then proliferate and carry out their specific effector functions, which in many cases successfully activate or eliminate the antigen. Thus, activating the immune response to a particular antigen associated with a cancer cell can protect the patient from developing cancer or result in lymphocytes eliminating cancer cells expressing the antigen.

Gene products, including polypeptides, mRNA (particularly mRNAs having distinct secondary and/or tertiary structures), cDNA, or complete gene, can be prepared and used in vaccines for the treatment or prevention of hyperproliferative disorders and cancers. The nucleic acids and polypeptides can be utilized to enhance the immune response, prevent tumor progression, prevent hyperproliferative cell growth, and the like. Methods for selecting nucleic acids and polypeptides that are capable of enhancing the immune response are known in the art. Preferably, the gene products for use in a vaccine are gene products which are present on the surface of a cell and are recognizable by lymphocytes and antibodies.

The gene products may be formulated with pharmaceutically acceptable carriers into pharmaceutical compositions by methods known in the art. The composition is useful as a vaccine to prevent or treat cancer. The composition may further comprise at least one co-immunostimulatory molecule, including but not limited to one or more major histocompatibility complex (MHC) molecules, such as a class I or class II molecule, preferably a class I molecule. The composition may further comprise other stimulator molecules including B7.1, B7.2, ICAM-1, ICAM-2, LFA-1, LFA-3, CD72 and the like, immunostimulatory polynucleotides (which comprise an 5'-CG-3' wherein the cytosine is unmethylated), and cytokines which include but are not limited to IL-1 through IL-15, TNF-α, IFN-γ, RANTES, G-CSF, M-CSF, IFN-α, CTAP III, ENA-78, GRO, I-309, PF-4, IP-10, LD-78, MGSA, MIP-1α, MIP-1β, or combination thereof, and the like for immunopotentiation. In one embodiment, the immunopotentiators of particular interest are those that facilitate a Th1 immune response.

The gene products may also be prepared with a carrier that will protect the gene products against rapid elimination from the body, such as a controlled release formulation, including implants and microencapsulated delivery systems. Biodegradable polymers can be used, such as ethylene vinyl acetate, polyanhydrides, polyglycolic acid, collagen, polyorthoesters, polylactic acid, and the like. Methods for preparation of such formulations are known in the art.

In the methods of preventing or treating cancer, the gene products may be administered via one of several routes including but not limited to transdermal, transmucosal, intravenous, intramuscular, subcutaneous, intradermal, intraperitoneal, intrathecal, intrapleural, intrauterine, rectal, vaginal, topical, intratumor, and the like. For transmucosal or transdermal administration, penetrants appropriate to the barrier to be permeated are used in the formulation. Such penetrants are generally known in the art, and include, for example, administration bile salts and fusidic acid derivatives. In addition, detergents may be used to facilitate permeation. Transmucosal administration may be by nasal sprays or suppositories. For oral administration, the gene products are formulated into conventional oral administration form such as capsules, tablets, elixirs and the like.

The gene product is administered to a patient in an amount effective to prevent or treat cancer. In general, it is desirable to provide the patient with a dosage of gene product of at least about 1 pg per Kg body weight, preferably at least about 1 ng per Kg body weight, more preferably at least about 1 μg or greater per Kg body weight of the recipient. A range of from about 1 ng per Kg body weight to about 100 mg per Kg body weight is preferred although a lower or higher dose may be administered. The dose is effective to prime, stimulate and/or cause the clonal expansion of antigen-specific T lymphocytes, preferably cytotoxic T lymphocytes, which in turn are capable of preventing or treating cancer in the recipient. The dose is administered at least once and may be provided as a bolus or a continuous administration. Multiple administrations of the dose over a period of several weeks to months may be preferable. Subsequent doses may be administered as indicated.

In another method of treatment, autologous cytotoxic lymphocytes or tumor infiltrating lymphocytes may be obtained from a patient with cancer. The lymphocytes are grown in culture, and antigen-specific lymphocytes are expanded by culturing in the presence of the specific gene products alone or in combination with at least one co-immunostimulatory molecule with cytokines. The antigen-specific lymphocytes are then infused back into the patient in an amount effective to reduce or eliminate the tumors in the patient. Cancer vaccines and their uses are further described in U.S. Pat. No. 5,961,978; U.S. Pat. No. 5,993,829; U.S. Pat. No. 6,132,980; and WO 00/38706.

Pharmaceutical Compositions and Uses

Pharmaceutical compositions can comprise polypeptides, receptors that specifically bind a polypeptide produced by a differentially expressed gene (e.g., antibodies, or polynucleotides (including antisense nucleotides and ribozymes) of the claimed invention in a therapeutically effective amount. The compositions can be used to treat primary tumors as well as metastases of primary tumors. In addition, the pharmaceutical compositions can be used in conjunction with conventional methods of cancer treatment, e.g., to sensitize tumors to radiation or conventional chemotherapy.

Where the pharmaceutical composition comprises a receptor (such as an antibody) that specifically binds to a gene product encoded by a differentially expressed gene, the receptor can be coupled to a drug for delivery to a treatment site or coupled to a detectable label to facilitate imaging of a site comprising cancer cells. Methods for coupling antibodies to drugs and detectable labels are well known in the art, as are methods for imaging using detectable labels.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature.

The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation is determined by routine experimentation and is within the judgment of the clinician. For purposes of the present invention, an effective dose will generally be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which can be administered without undue toxicity. Suitable carriers can be large, slowly metabolized macromolecules such as proteins, polysaccharides, polylactic acids, polyglycolic acids, polymeric amino acids, amino acid copolymers, lipid aggregates and inactive virus particles. Such carriers are well known to those of ordinary skill in the art. Pharmaceutically acceptable carriers in therapeutic compositions can include liquids such as water, saline, glycerol and ethanol. Auxiliary substances, such as wetting or emulsifying agents, pH buffering substances, and the like, can also be present in such vehicles.

Typically, the therapeutic compositions are prepared as injectables, either as liquid solutions or suspensions; solid forms suitable for solution in, or suspension in, liquid vehicles prior to injection can also be prepared. Liposomes are included within the definition of a pharmaceutically acceptable carrier. Pharmaceutically acceptable salts can also be present in the pharmaceutical composition, e.g., mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in *Remington: The Science and Practice of Pharmacy* (1995) Alfonso Gennaro, Lippincott, Williams, & Wilkins.

Delivery Methods

Once formulated, the compositions contemplated by the invention can be (1) administered directly to the subject (e.g., as polynucleotide, polypeptides, small molecule agonists or antagonists, and the like); or (2) delivered ex vivo, to cells derived from the subject (e.g., as in ex vivo gene therapy). Direct delivery of the compositions will generally be accomplished by parenteral injection, e.g., subcutaneously, intraperitoneally, intravenously or intramuscularly, intratumoral or to the interstitial space of a tissue. Other modes of administration include oral and pulmonary administration, suppositories, and transdermal applications, needles, and gene guns or hyposprays. Dosage treatment can be a single dose schedule or a multiple dose schedule.

Methods for the ex vivo delivery and reimplantation of transformed cells into a subject are known in the art and described in e.g., International Publication No. WO 93/14778. Examples of cells useful in ex vivo applications include, for example, stem cells, particularly hematopoetic, lymph cells, macrophages, dendritic cells, or tumor cells. Generally, delivery of nucleic acids for both ex vivo and in vitro applications can be accomplished by, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Once differential expression of a gene corresponding to a polynucleotide described herein has been found to correlate with a proliferative disorder, such as neoplasia, dysplasia, and hyperplasia, the disorder can be amenable to treatment by administration of a therapeutic agent based on the provided polynucleotide, corresponding polypeptide or other corresponding molecule (e.g., antisense, ribozyme, etc.). In other embodiments, the disorder can be amenable to treatment by administration of a small molecule drug that, for example, serves as an inhibitor (antagonist) of the function of the encoded gene product of a gene having increased expression in cancerous cells relative to normal cells or as an agonist for gene products that are decreased in expression in cancerous cells (e.g., to promote the activity of gene products that act as tumor suppressors).

The dose and the means of administration of the inventive pharmaceutical compositions are determined based on the specific qualities of the therapeutic composition, the condition, age, and weight of the patient, the progression of the disease, and other relevant factors. For example, administration of polynucleotide therapeutic composition agents includes local or systemic administration, including injection, oral administration, particle gun or catheterized administration, and topical administration. In general, the therapeutic polynucleotide composition contains an expression construct comprising a promoter operably linked to a polynucleotide of at least 12, 22, 25, 30, or 35 contiguous nt of the polynucleotide disclosed herein. Various methods can be used to administer the therapeutic composition directly to a specific site in the body. For example, a small metastatic lesion is located and the therapeutic composition injected several times in several different locations within the body of the tumor. Alternatively, arteries which serve a tumor are identified, and the therapeutic composition injected into such an artery, in order to deliver the composition directly into the tumor. A tumor that has a necrotic center is aspirated and the composition injected directly into the now empty center of the tumor. The antisense composition is directly administered to the surface of the tumor, for example, by topical application of the composition. X-ray imaging is used to assist in certain of the above delivery methods.

Targeted delivery of therapeutic compositions containing an antisense polynucleotide, subgenomic polynucleotides, or antibodies to specific tissues can also be used. Receptor-mediated DNA delivery techniques are described in, for example, Findeis et al., Trends Biotechnol. (1993) 11:202; Chiou et al., Gene Therapeutics: Methods And Applications Of Direct Gene Transfer (J. A. Wolff, ed.) (1994); Wu et al., J. Biol. Chem. (1988) 263:621; Wu et al., J. Biol. Chem. (1994) 269:542; Zenke et al., Proc. Natl. Acad. Sci. (USA) (1990) 87:3655; Wu et al., J. Biol. Chem. (1991) 266:338. Therapeutic compositions containing a polynucleotide are administered in a range of about 100 ng to about 200 mg of DNA for local administration in a gene therapy protocol. Concentration ranges of about 500 ng to about 50 mg, about 1 μg to about 2 mg, about 5 μg to about 500 μg, and about 20 μg to about 100 :g of DNA can also be used during a gene therapy protocol. Factors such as method of action (e.g., for enhancing or inhibiting levels of the encoded gene product) and efficacy of transformation and expression are considerations that will affect the dosage required for ultimate efficacy of the antisense subgenomic polynucleotides.

The therapeutic polynucleotides and polypeptides of the present invention can be delivered using gene delivery vehicles. The gene delivery vehicle can be of viral or non-viral origin (see generally, Jolly, Cancer Gene Therapy (1994) 1:51; Kimura, Human Gene Therapy (1994) 5:845; Connelly, Human Gene Therapy (1995) 1:185; and Kaplitt, Nature Genetics (1994) 6:148). Expression of such coding sequences can be induced using endogenous mammalian or heterologous promoters. Expression of the coding sequence can be either constitutive or regulated.

Viral-based vectors for delivery of a desired polynucleotide and expression in a desired cell are well known in the art. Exemplary viral-based vehicles include, but are not limited to, recombinant retroviruses (see, e.g., WO 90/07936; WO 94/03622; WO 93/25698; WO 93/25234; U.S. Pat. No. 5,219, 740; WO 93/11230; WO 93/10218; U.S. Pat. No. 4,777,127; GB Patent No. 2,200,651; EP 0 345 242; and WO 91/02805), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532), and adeno-associated virus (AAV) vectors (see, e.g., WO 94/12649, WO 93/03769; WO 93/19191; WO 94/28938; WO 95/11984 and WO 95/00655). Administration of DNA linked to killed adenovirus as described in Curiel, Hum. Gene Ther. (1992) 3:147 can also be employed.

Non-viral delivery vehicles and methods can also be employed, including, but not limited to, polycationic condensed DNA linked or unlinked to killed adenovirus alone (see, e.g., Curiel, Hum. Gene Ther. (1992) 3:147); ligand-linked DNA (see, e.g., Wu, J. Biol. Chem. (1989) 264:16985); eukaryotic cell delivery vehicles cells (see, e.g., U.S. Pat. No. 5,814,482; WO 95/07994; WO 96/17072; WO 95/30763; and WO 97/42338) and nucleic charge neutralization or fusion with cell membranes. Naked DNA can also be employed. Exemplary naked DNA introduction methods are described in WO 90/11092 and U.S. Pat. No. 5,580,859. Liposomes that can act as gene delivery vehicles are described in U.S. Pat. No. 5,422,120; WO 95/13796; WO 94/23697; WO 91/14445; and EP 0524968. Additional approaches are described in Philip, Mol. Cell Biol. (1994) 14:2411, and in Woffendin, Proc. Natl. Acad. Sci. (1994) 91:1581.

Tumor Classification and Patient Stratification

The invention further provides for methods of classifying tumors, and thus grouping or "stratifying" patients, according to the expression profile of selected differentially expressed genes in a tumor. The expression patterns of differentially expressed genes can be analyzed for correlation with the expression patterns of other differentially expressed genes in a single tumor type or across tumor types. Genes that demonstrate consistent correlation can be grouped together, e.g., genes are grouped together where if one gene is overexpressed in a tumor, a second gene is also usually overexpressed. Tumors can then be classified according to the expression profile of one or more genes selected from one or more groups.

For example, a colon tumor can be classified according to expression level of a gene product of one or more genes selected from one or more of the following groups: 1) Group I, which comprises the genes IGF2, TTK, MAPKAPK2, MARCKS, BBS2, CETN2 CGI-148 protein, FGFR4, FHL3, FLJ22066, KIP2, MGC:29604, NQO2, and OGG1; and 2) Group II, which comprises the genes IFITM (I-8U; 1-8D; 9-27), ITAK, and BIRC3/H-IAP 1.

A Group I-type colon tumor has increased expression of at least one, usually at least two, more usually at least three, even more usually at least four, preferably at least five, more preferably at least six or more, but usually not more than 12, 10, or 8, Group I genes relative to a non-cancerous colon cell, where the expression is increased at least about 1.5-fold, at least about 2-fold, at least about 5-fold, or at least about 10-fold, and can be as high 50-fold, but is usually not more than 20-fold or 30-fold.

A Group II-type colon tumor is increased in expression of at least one, usually at least two, more usually at least three, Group II genes relative to a non-cancerous colon cells, where the expression is increased at least about 1.5-fold, at least about 2-fold, at least about 5-fold, or at least about 10-fold, and can be as high 50-fold, but is usually not more than 20-fold or 30-fold.

A Group I+II-type colon tumor is increased in expression of at least one, usually at least two, more usually at least three, even more usually at least four, preferably at least five, more preferably at least six or more, but usually not more than 12, 10, or 8, Group I genes relative to a non-cancerous colon cell, and has increased expression of at least one, usually at least two, more usually at least three, Group II genes relative to a non-cancerous colon cells, where expression of both the Group I and Group II genes is increased at least about 1.5-fold, at least about 2-fold, at least about 5-fold, or at least about 10-fold, and can be as high 50-fold, but is usually not more than 20-fold or 30-fold.

The tumor of each patient in a pool of potential patients for a clinical trial can be classified as described above. Patients having similarly classified tumors can then be selected for participation in an investigative or clinical trial of a cancer therapeutic where a homogeneous population is desired. The tumor classification of a patient can also be used in assessing the efficacy of a cancer therapeutic in a heterogeneous patient population. Thus, comparison of an individual's expression profile to the population profile for a type of cancer, permits the selection or design of drugs or other therapeutic regimens that are expected to be safe and efficacious for a particular patient or patient population (i.e., a group of patients having the same type of cancer).

In addition, the ability to target populations expected to show the most clinical benefit, based on expression profile can enable: 1) the repositioning of already marketed drugs; 2) the rescue of drug candidates whose clinical development has been discontinued as a result of safety or efficacy limitations, which are patient subgroup-specific; and 3) an accelerated and less costly development for candidate therapeutics and more optimal drug labeling (e.g. since measuring the effect of various doses of an agent on patients with a particular expression profile is useful for optimizing effective dose).

A certain embodiment of the invention is based on the discovery of genes differentially expressed in cancerous colon cells relative to normal cells, particularly metastatic or pre-metastatic cancerous colon cells relative to normal cells of the same tissue type. The genes of particular interest are those described in the Examples below. The invention is further based on the discovery that colon tumors can be classified according to the expression pattern of one or more of genes, and that patients can thus be classified and diagnosed, and therapy selected accordingly, according to these expression patterns. The gene(s) for analysis of expression of a gene product encoded by at least one gene selected from at least one of the following groups: 1) Group I, which comprises the genes IGF2, TTK, MAPKAPK2, MARCKS, BBS2, CETN2 CGI-148 protein, FGFR4, FHL3, FLJ22066, KIP2, MGC: 29604, NQO2, and OGG1; and 2) Group II, which comprises the genes IFITM (I-8U; 1-8D; 9-27), ITAK, and BIRC3/H-IAP1. A tumor can then be classified as a Group I-type, Group II-type, or Group I+II-type tumor based on the expression profile of the tumor. The expression patterns associated with colon cancer, and which provide the basis for tumor classification and patient stratification, are described in the Examples below.

The methods of the invention can be carried out using any suitable probe for detection of a gene product that is differentially expressed in colon cancer cells. For example, mRNA (or cDNA generated from mRNA) expressed from a differentially expressed gene can be detected using polynucleotide probes. In another example, the differentially expressed gene product is a polypeptide, which polypeptides can be detected using, for example, antibodies that specifically bind such polypeptides or an antigenic portion thereof.

The present invention relates to methods and compositions useful in diagnosis of colon cancer, design of rational therapy, and the selection of patient populations for the purposes of clinical trials. The invention is based on the discovery that colon tumors of a patient can be classified according to an expression profile of one or more selected genes, which genes are differentially expressed in tumor cells relative to normal cells of the same tissue. Polynucleotides that correspond to the selected differentially expressed genes can be used in diagnostic assays to provide for diagnosis of cancer at the molecular level, and to provide for the basis for rational therapy (e.g., therapy is selected according to the expression pattern of a selected set of genes in the tumor). The gene products encoded by differentially expressed genes can also serve as therapeutic targets, and candidate agents effective against such targets screened by, for example, analyzing the ability of candidate agents to modulate activity of differentially expressed gene products.

In one aspect, the selected gene(s) for tumor cell (and thus patient) analysis of expression of a gene product encoded by at least one gene selected from at least one of the following groups: 1) Group I, which comprises the genes IGF2, TTK, MAPKAPK2, MARCKS, BBS2, CETN2 CGI-148 protein, FGFR4, FHL3, FLJ22066, KIP2, MGC:29604, NQO2, and OGG1; and 2) Group II, which comprises the genes IFITM (1-8U; 1-8D; 9-27), ITAK, and BIRC3/H-IAP1.

In another aspect, the invention provides a method for classifying a tumor that shares selected characteristics with respect to a tumor expression profile. In one embodiment, the invention provides a method for classifying a tumor according to an expression profile of one or more genes comprising detecting expression of at least a first Group I gene in a test colon cell sample. Detection of increased expression of the first gene in the test colon cell sample relative to expression of the gene in a control non-cancer cell sample indicates that the tumor is a Group I-type tumor.

In one embodiment, the first Group I gene is an IGF2 gene. In other specific embodiments, the method further comprises detecting expression of a second Group I gene in the test colon cell sample. Detection of increased expression of the first and second genes in the test colon cell sample relative to expression of the first and second genes, respectively, in a control non-cancer cell sample indicates that the tumor is a Group I-type tumor.

In another embodiment, the method further comprises detecting expression of a second and third Group I gene in the test colon cell sample. Detection of increased expression of the first, second, and third genes in the test colon cell sample relative to expression of the first, second, and third genes, respectively, in a control non-cancer cell sample indicates that the tumor is a Group I-type tumor. In other embodiments, the expression of the gene(s) is increased about 1.5-fold, about 2-fold, about 5-fold, or about 10-fold in the test sample relative to the control sample.

In another embodiment, the invention provides a method for classifying a tumor according to an expression profile of one or more genes comprising detecting expression of at least a first Group II gene in a test colon cell sample. Detection of increased expression of the first gene in the test colon cell sample relative to expression of the gene in a control non-cancer cell sample indicates that the tumor is a Group II-type tumor.

In another embodiment, the first Group II gene is a member of the IFITM family of genes. In other specific embodiments, the method further comprises detecting expression of a second Group II gene in the test colon cell sample. Detection of increased expression of the first and second genes in the test colon cell sample relative to expression of the first and second genes, respectively, in a control non-cancer cell sample indicates that the tumor is a Group II-type tumor. In other embodiments, the expression of the gene(s) is increased about 1.5-fold, about 2-fold, about 5-fold, or about 10-fold in the test sample relative to the control sample. In yet other specific embodiments, the first Group II gene is 1-8U, 1-8D, or 9-27.

In another embodiment, the invention provides a method for classifying a tumor according to an expression profile of two or more genes, the method comprising analyzing a test colon cell sample for expression of at least one Group I gene and at least one Group II gene. Detection of increased expression of the at least one Group I gene and the at least one Group II gene in the test cell sample relative to expression of the at least one Group I gene and the at least one Group II gene, respectively, in a control non-cancer cell sample indicates the tumor is a Group I+II-type tumor. In other embodiments, the Group I gene is an IGF2 gene and the Group II gene is a member of the IFITM family of genes. In yet other embodiments, the expression of the genes is increased about 1.5-fold, about 2-fold, about 5-fold, or about 10-fold in the test sample relative to the control sample.

In another aspect, the invention provides methods for selection of a patient population having a tumor that shares selected characteristics, with respect to a tumor expression profile. This method, referred to herein as "patient stratification," can be used to improve the design of a clinical trial by providing a patient population that is more homogenous with respect to the tumor type that is to be tested for responsiveness to a new therapy; and in selecting the best therapeutic regiment for a patient in view of an expression profile of the subject's tumor (e.g., rational therapy).

In another aspect, the invention provides a method for selecting an individual for inclusion in a clinical trial, the method comprising the steps of: detecting a level of expression of a gene product in a test colon cell sample or serum obtained from a subject, the gene product being encoded by at least one gene selected from the group consisting of IGF2, TTK, MAPKAPK2, MARCKS, BBS2, CETN2 CGI-148 protein, FGFR4, FHL3, FLJ22066, KIP2, MGC:29604, NQO2, and OGG1; and comparing the level of expression of the gene product in the test sample to a level of expression in a normal colon cell; wherein detection of a level of expression of the gene product that is significantly higher in the test sample than in a normal cell is a positive indicator for inclusion of the subject in the test population for the clinical trial.

In another aspect the invention provides a method for selecting an individual for inclusion in a clinical trial, the method comprising the steps of: detecting a level of expression of a gene product in a test colon cell sample obtained from a subject, the gene product being encoded by at least one gene selected from the group consisting of: IFITM 1-8U; 1-8D; 9-27), ITAK, and BIRC3/H-IAP1; and comparing the level of expression of the gene product in the test sample to a level of expression in a normal colon cell; wherein detection of a level of expression of the gene product that is significantly higher in the test sample than in a normal cell is a positive indicator for inclusion of the subject in the test population for the clinical trial.

In related aspects the invention provides methods of reducing growth of cancerous colon cells by modulation of expression of one or more gene products corresponding to a gene selected from: 1) Group I, which comprises the genes IGF2, TTK, MAPKAPK2, MARCKS, BBS2, CETN2 CGI-148 protein, FGFR4, FHL3, FLJ22066, KIP2, MGC:29604, NQO2, and OGG1; and 2) Group II, which comprises the genes IFITM (I-8U; 1-8D; 9-27), ITAK, and BIRC3/H-IAP1. These methods are useful for treating colon cancer.

In another aspect, the present invention provides methods for disease detection by analysis of gene expression. In general, diagnostic and prognostic methods of the invention can involve obtaining a test cell from a subject, e.g., colon cells; detecting the level of expression of any one gene or a selected set of genes in the test cell, where the gene(s) are differentially expressed in a colon tumor cell relative to a normal colon cell; and comparing the expression levels of the gene(s) in the test cell to a control level (e.g., a level of expression in a normal (non-cancerous) colon cell). Detection of a level of expression in the test cell that differs from that found in a normal cell indicates that the test cell is a cancerous cell. The method of the invention permits, for example, detection of a small increase or decrease in gene product production from a gene whose overexpression or underexpression (compared to a reference gene) is associated with cancer or the predisposition for a cancer.

In another aspect the invention provides a method for detecting a cancerous colon cell comprising contacting a sample obtained from a test colon cell with a probe for detection of a gene product of a gene differentially expressed in colon cancer, wherein the gene corresponds to a polynucleotide having a sequence selected from the group consisting of SEQ ID NOS: 1-20, and where contacting is for a time sufficient for binding of the probe to the gene product; and comparing a level of binding of the probe to the sample with a level of probe binding to a control sample obtained from a control colon cell, wherein the control colon cell is of known cancerous state. An increased level of binding of the probe in the test colon cell sample relative to the level of binding in a control sample is indicative of the cancerous state of the test colon cell. In specific embodiments, the probe is a polynucleotide probe and the gene product is nucleic acid. In other specific embodiments, the gene product is a polypeptide. In further embodiments, the gene product or the probe is immobilized on an array.

In another aspect, the invention provides a method for assessing the cancerous phenotype (e.g., metastasis, aberrant cellular proliferation, and the like) of a colon cell comprising detecting expression of a gene product in a test colon cell sample, wherein the gene comprises a sequence selected from the group consisting of SEQ ID NOS: 1-20; and comparing a level of expression of the gene product in the test colon cell sample with a level of expression of the gene in a control cell sample. Comparison of the level of expression of the gene in the test cell sample relative to the level of expression in the control cell sample is indicative of the cancerous phenotype of the test cell sample. In specific embodiments, detection of expression of the gene is by detecting a level of an RNA transcript in the test cell sample. In other specific embodiments detection of expression of the gene is by detecting a level of a polypeptide in a test sample.

In another aspect, the invention provides a method for suppressing or inhibiting a cancerous phenotype of a cancerous cell, the method comprising introducing into a mammalian cell an antisense polynucleotide for inhibition of expression of a gene comprising a sequence selected from the group consisting of SEQ ID NOS: 1-20. Inhibition of expression of the gene inhibits development of a cancerous phenotype in the cell. In specific embodiments, the cancerous phenotype is metastasis, aberrant cellular proliferation relative to a normal cell, or loss of contact inhibition of cell growth.

In another aspect, the invention provides a method for assessing the tumor burden of a subject, the method comprising detecting a level of a differentially expressed gene product in a test sample from a subject suspected of or having a tumor, the differentially expressed gene product comprising a sequence selected from the group consisting of SEQ ID NOS: 1-20. Detection of the level of the gene product in the test sample is indicative of the tumor burden in the subject.

In another aspect, the invention provides a method for identifying a gene product as a target for a cancer therapeutic, the method comprising contacting a cancerous cell expressing a candidate gene product with an anti-cancer agent, wherein the candidate gene product corresponds to a sequence selected from the group consisting of SEQ ID NOS: 1-20; and analyzing the effect of the anti-cancer agent upon a biological activity of the candidate gene product and upon a cancerous phenotype of the cancerous cell. Modulation of the biological activity of the candidate gene product and modulation of the cancerous phenotype of the cancerous cell indicates the candidate gene product is a target for a cancer therapeutic. In specific embodiments, the cancerous cell is a cancerous colon cell. In other specific embodiments, the inhibitor is an antisense oligonucleotide. In further embodiments, the cancerous phenotype is aberrant cellular proliferation relative to a normal cell, or colony formation due to loss of contact inhibition of cell growth.

In another aspect, the invention provides a method for identifying agents that decrease biological activity of a gene product differentially expressed in a cancerous cell, the method comprising contacting a candidate agent with a differentially expressed gene product, the differentially expressed gene product corresponding to a sequence selected from the group consisting of SEQ ID NOS: 1-20; and detecting a decrease in a biological activity of the gene product relative to a level of biological activity of the gene product in the absence of the candidate agent. In specific embodiments, the detecting is by detection of a decrease in expression of the differentially expressed gene product. In other specific embodiments, the gene product is mRNA or cDNA prepared from the mRNA gene product. In further embodiments, the gene product is a polypeptide.

In all embodiments of the invention, analysis of expression of a gene product of a selected gene can be accomplished by analysis of gene transcription (e.g., by generating cDNA clones from mRNAs isolated from a cell suspected of being cancerous and comparing the number of cDNA clones corresponding to the gene in the sample relative to a number of clones present in a non-cancer cell of the same tissue type), detection of an encoded gene product (e.g., assessing a level of polypeptide encoded by a selected gene present in the test cell suspected of being cancerous relative to a level of the polypeptide in a non-cancer cell of the same tissue type), detection of a biological activity of a gene product encoded by a selected gene, and the like.

In all embodiments of the invention, comparison of gene product expression of a selected gene in a tumor cell can involve, for example, comparison to an "internal" control cell (e.g., a non-cancer cell of the same tissue type obtained from the same patient from whom the sample suspected of having a tumor cell was obtained), comparison to a control cell analyzed in parallel in the assay (e.g., a non-cancer cell, normally of the same tissue type as the test cell or a cancerous cell, normally of the same tissue type as the test cell), or comparison to a level of gene product expression known to be associated with a normal cell or a cancerous cell, normally of the same tissue type (e.g., a level of gene product expression is compared to a known level or range of levels of gene product expression for a normal cell or a cancerous cell, which can be provided in the form of, for example, a standard).

The sequences disclosed in this patent application were disclosed in several earlier patent applications. The relationship between the SEQ ID NOS in those earlier applications and the SEQ ID NOS disclosed herein is as follows. SEQ ID NOS: 1-321 of parent case 15805CON (Ser. No. 10/616,900, filed Jul. 9, 2003) correspond to SEQ ID NOS: 1-321 of the present application. SEQ ID NOS: 1-20 of parent case 16335 (Ser. No. 10/081,519, filed Feb. 21, 2002) correspond to SEQ ID NOS: 322-341 of the present application. SEQ ID NOS: 1-2164 of parent case 18095 (Ser. No. 10/310,673, filed Dec. 4, 2002) correspond to SEQ ID NOS: 342-2505 of the present application. SEQ ID NOS: 1-516 of parent case 17767 (Ser. No. 10/501,187, filed Jul. 8, 2004) correspond to SEQ ID NOS: 2506-3021 of the present application. SEQ ID NOS: 1-1303 of parent case 16336 (Ser. No. 10/081,124, filed Feb. 21, 2002) correspond to SEQ ID NOS: 3022-4324 of the present application. SEQ ID NOS: 1-9672 of parent case 18376 (US04/15421, filed May 13, 2004) correspond to SEQ ID NOS: 4325-13996 of the present application.

The disclosures of all prior U.S. applications to which the present application claims priority, which includes those U.S. applications referenced in the table above as well as their respective priority applications, are each incorporated herein by referenced in their entireties for all purposes, including the disclosures found in the Sequence Listings, tables, figures and Examples.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Centigrade, and pressure is at or near atmospheric.

Example 1

Source of Biological Materials and Isolation of Polynucleotides Expressed by the Biological Materials Candidate polynucleotides that may represent genes differentially expressed in cancer were obtained from both publicly available sources and from cDNA libraries generated from selected cell lines and patient tissues. In order to obtain the latter polynucleotides, mRNA was isolated from several selected cell lines and patient tissues, and used to construct cDNA libraries. The cells and tissues that served as sources for these cDNA libraries are summarized in Table 1 below.

TABLE 1

Description of cDNA Libraries

| Library (lib #) | Description | Number of Clones in Library |
|---|---|---|
| 1 | Human Colon Cell Line Km12 L4: High Metastatic Potential (derived from Km12C) | 308731 |
| 2 | Human Colon Cell Line Km12C: Low Metastatic Potential | 284771 |
| 3 | Human Breast Cancer Cell Line MDA-MB-231: High Metastatic Potential; micro-mets in lung | 326937 |
| 4 | Human Breast Cancer Cell Line MCF7: Non Metastatic | 318979 |
| 8 | Human Lung Cancer Cell Line MV-522: High Metastatic Potential | 223620 |
| 9 | Human Lung Cancer Cell Line UCP-3: Low Metastatic Potential | 312503 |
| 12 | Human microvascular endothelial cells (HMVEC) - UNTREATED (PCR (OligodT) cDNA library) | 41938 |
| 13 | Human microvascular endothelial cells (HMVEC) - bFGF TREATED (PCR (OligodT) cDNA library) | 42100 |
| 14 | Human microvascular endothelial cells (HMVEC) - VEGF TREATED (PCR (OligodT) cDNA library) | 42825 |
| 15 | Normal Colon - UC#2 Patient (MICRODISSECTED PCR (OligodT) cDNA library) | 248436 |
| 16 | Colon Tumor - UC#2 Patient (MICRODISSECTED PCR (OligodT) cDNA library) | 263206 |

TABLE 1-continued

Description of cDNA Libraries

| Library (lib #) | Description | Number of Clones in Library |
|---|---|---|
| 17 | Liver Metastasis from Colon Tumor of UC#2 Patient (MICRODISSECTED PCR (OligodT) cDNA library) | 266482 |
| 18 | Normal Colon - UC#3 Patient (MICRODISSECTED PCR (OligodT) cDNA library) | 36216 |
| 19 | Colon Tumor - UC#3 Patient (MICRODISSECTED PCR (OligodT) cDNA library) | 41388 |
| 20 | Liver Metastasis from Colon Tumor of UC#3 Patient (MICRODISSECTED PCR (OligodT) cDNA library) | 30956 |
| 21 | GRRpz Cells derived from normal prostate epithelium | 164801 |
| 22 | WOca Cells derived from Gleason Grade 4 prostate cancer epithelium | 162088 |
| 23 | Normal Lung Epithelium of Patient #1006 (MICRODISSECTED PCR (OligodT) cDNA library) | 306197 |
| 24 | Primary tumor, Large Cell Carcinoma of Patient #1006 (MICRODISSECTED PCR (OligodT) cDNA library) | 309349 |

The human colon cancer cell line Km12L4-A (Morikawa, et al., *Cancer Research* (1988) 6863) is derived from the KM12C cell line. The KM12C cell line (Morikawa et al *Cancer Res*. (1988) 48:1943-1948), which is poorly metastatic (low metastatic) was established in culture from a Dukes stage $B_2$ surgical specimen (Morikawa et al. *Cancer Res*. (1988) 48:6863). The KML4-A is a highly metastatic subline derived from KM12C (Yeatman et al. *Nucl. Acids. Res*. (1995) 23:4007; Bao-Ling et al. *Proc. Annu. Meet. Am. Assoc. Cancer. Res*. (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res*. (1995) 1:19; Yeatman et al., (1995) supra; Yeatman et al. *Clin. Exp. Metastasis* (1996)14:246).

The MDA-MB-231 cell line (Brinkley et al. *Cancer Res*. (1980) 40:3118-3129) was originally isolated from pleural effusions (Cailleau, *J. Natl. Cancer. Inst*. (1974) 53:661) is of high metastatic potential, and forms poorly differentiated adenocarcinoma grade II in nude mice consistent with breast carcinoma. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res*. (1979) 9:870 (MDA-MB-231 and MCF-7); Gastpar et al., *J Med Chem* (1998) 41:4965 MDA-MB-231 and MCF-7); Ranson et al., *Br J Cancer* (1998) 77:1586 (MDA-MB-231 and MCF-7); Kuang et al., *Nucleic Acids Res* (1998) 26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res*. (1990) 10:637; (MV-522); Kelner et al., *Anticancer Res* (1995) 15:867 (MV-522); and Zhang et al., *Anticancer Drugs* (1997) 8:696 (MV522)).

The samples of libraries 15-20 are derived from two different patients (UC#2, and UC#3). The bFGF-treated HMVEC were prepared by incubation with bFGF at 10 ng/ml for 2 hrs; the VEGF-treated HMVEC were prepared by incubation with 20 ng/ml VEGF for 2 hrs. Following incubation with the respective growth factor, the cells were washed and lysis buffer added for RNA preparation. The GRRpz and WOca cell lines were provided by Dr. Donna M. Peehl, Department of Medicine, Stanford University School of Medicine. GRRpz was derived from normal prostate epithelium. The WOca cell line is a Gleason Grade 4 cell line.

Characterization of Sequences in the Libraries

The sequences of the isolated polynucleotides were first masked to eliminate low complexity sequences using the XBLAST masking program (Claverie "Effective Large-Scale Scale Sequence Similarity Searches," In: *Computer Methods for Macromolecular Sequence Analysis*, Doolittle, ed., *Meth. Enzymol.* 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem*. (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. Masking resulted in the elimination of several sequences. The remaining sequences were then used in a BLASTN vs. GenBank search. Gene assignment for the query sequences was determined based on best hit from the GenBank database; expectancy values are provided with the hit.

Summary of Polynucleotides Described Herein

Table 2 provides a summary of polynucleotides isolated as described above and identified as corresponding to a differentially expressed gene (see Example 2 below), as well as those polynucleotides obtained from publicly available sources. Specifically, Table 2 provides: 1) the SEQ ID NO assigned to each sequence for use in the present specification; 2) the Candidate Identification Number ("CID") to which the sequence is assigned and which number is based on the selection of the candidate for further evaluation in the differential expression in cancerous cells relative to normal cells; 3) the Sequence Name assigned to each sequence; and 4) the name assigned to the sample or clone from which the sequence was isolated. The sequences corresponding to SEQ ID NOS are provided in the Sequence Listing. Because at least some of the provided polynucleotides represent partial mRNA transcripts, two or more polynucleotides may represent different regions of the same mRNA transcript and the same gene and/or may be contained within the same clone. Thus, if two or more SEQ ID NOS are identified as belonging to the same clone, then either sequence can be used to obtain the full-length mRNA or gene. It should be noted that not all cDNA libraries described above are represented on an array in the examples described below.

TABLE 2

| SEQ ID NO | CID | Sequence Name | Sample Name or Clone Name |
|---|---|---|---|
| 1 | 114 | 016824.Seq | M00003814C:C11 |
| 2 | 123 | 019.G3.sp6_128473 | M00006883D:H12 |

TABLE 2-continued

| SEQ ID NO | CID | Sequence Name | Sample Name or Clone Name |
|---|---|---|---|
| 3 | 114 | 020.B11.sp6__128613 | M00003814C:C11 |
| 4 | 1 | 1222317 | I:1222317:15A02:C02 |
| 5 | 2 | 1227385 | I:1227385:14B01:G05 |
| 6 | 3 | 1297179 | I:1297179:05A02:F02 |
| 7 | 4 | 1298021 | I:1298021:05A01:G10 |
| 8 | 5 | 1358285 | I:1358285:04A02:F11 |
| 9 | 6 | 1384823 | I:1384823:01B02:F08 |
| 10 | 7 | 1395918 | I:1395918:04A01:G10 |
| 11 | 8 | 1402615 | I:1402615:09A02:E03 |
| 12 | 9 | 1421929 | I:1421929:05A01:D02 |
| 13 | 10 | 1431819 | I:1431819:14B01:D05 |
| 14 | 11 | 1443877 | I:1443877:03B02:B08 |
| 15 | 12 | 1450639 | I:1450639:03B02:E09 |
| 16 | 13 | 1480159 | I:1480159:06B02:E03 |
| 17 | 14 | 1509602 | I:1509602:04A01:A11 |
| 18 | 15 | 1516301 | I:1516301:05B01:C10 |
| 19 | 167 | 1598.C19.gz43__212821 | M00055583C:B07 |
| 20 | 16 | 1600586 | I:1600586:05B02:F04 |
| 21 | 17 | 1609538 | I:1609538:06A02:F04 |
| 22 | 18 | 1613615 | I:1613615:03B01:D10 |
| 23 | 19 | 1630804 | I:1630804:06A02:F10 |
| 24 | 20 | 1633286 | I:1633286:06A02:E04 |
| 25 | 21 | 1666080 | I:1666080:07B02:D04 |
| 26 | 22 | 1699587 | I:1699587:06A02:F11 |
| 27 | 23 | 1702266 | I:1702266:02B01:D09 |
| 28 | 24 | 1712592 | I:1712592:04A01:E03 |
| 29 | 25 | 1723834 | I:1723834:01A01:C02 |
| 30 | 26 | 1743234 | I:1743234:16B01:D09 |
| 31 | 170 | 1744.K05.gz43__221934 | M00056250C:B02 |
| 32 | 27 | 1749417 | I:1749417:04A02:D10 |
| 33 | 28 | 1749883 | I:1749883:05B01:D04 |
| 34 | 29 | 1750782 | I:1750782:02A01:A08 |
| 35 | 30 | 1758241 | I:1758241:15B02:G04 |
| 36 | 31 | 1809385 | I:1809385:02A02:G04 |
| 37 | 32 | 1810640 | I:1810640:01A02:D06 |
| 38 | 33 | 1817434 | I:1817434:02B01:C02 |
| 39 | 34 | 1833191 | I:1833191:14A01:G05 |
| 40 | 35 | 1854245 | I:1854245:02B02:E10 |
| 41 | 36 | 1854558 | I:1854558:03A01:C11 |
| 42 | 37 | 1857563 | I:1857563:05B02:D01 |
| 43 | 38 | 1920522 | I:1920522:15B02:F02 |
| 44 | 39 | 1920650 | I:1920650:16A01:B01 |
| 45 | 41 | 1923490 | I:1923490:18B01:H08 |
| 46 | 42 | 1923769 | I:1923769:16B01:F01 |
| 47 | 43 | 1926006 | I:1926006:15A01:F09 |
| 48 | 44 | 1931371 | I:1931371:02B02:D12 |
| 49 | 45 | 1960722 | I:1960722:13B02:D11 |
| 50 | 46 | 1963753 | I:1963753:18B01:E07 |
| 51 | 47 | 1965257 | I:1965257:18B02:B04 |
| 52 | 48 | 1967543 | I:1967543:16B02:F06 |
| 53 | 49 | 1968921 | I:1968921:15A02:D06 |
| 54 | 50 | 1969044 | I:1969044:18B01:E12 |
| 56 | 53 | 1996180 | I:1996180:19B01:C11 |
| 57 | 54 | 2054678 | I:2054678:19A01:F10 |
| 58 | 55 | 2055926 | I:2055926:14A01:F11 |
| 59 | 56 | 2056395 | I:2056395:13A02:B07 |
| 60 | 58 | 2060725 | I:2060725:13A01:G10 |
| 61 | 59 | 2079906 | I:2079906:01A02:A06 |
| 62 | 60 | 2152363 | I:2152363:04A02:A08 |
| 63 | 63 | 2239819 | I:2239819:04A02:B11 |
| 64 | 64 | 2359588 | I:2359588:18A01:F03 |
| 65 | 65 | 2458926 | I:2458926:03B01:C07 |
| 66 | 66 | 2483109 | I:2483109:05A01:A06 |
| 67 | 67 | 2499479 | I:2499479:05A01:D06 |
| 68 | 68 | 2499976 | I:2499976:01B02:E09 |
| 70 | 71 | 2615513 | I:2615513:04B01:D09 |
| 71 | 74 | 2675481 | I:2675481:05A01:G06 |
| 73 | 100 | 268.H2.sp6__144757 | M00001341B:A11 |
| 74 | 105 | 270.B6.sp6__145073 | M00001402B:C12 |
| 75 | 106 | 270.C6.sp6__145085 | M00001402C:B01 |
| 76 | 104 | 270.H3.sp6__145142 | M00001393D:F01 |
| 77 | 75 | 2759046 | I:2759046:19B02:C05 |
| 78 | 76 | 2825369 | I:2825369:07A02:F09 |
| 79 | 77 | 2840195 | I:2840195:01B02:G11 |
| 80 | 78 | 2902903 | I:2902903:12A02:F02 |
| 81 | 79 | 2914605 | I:2914605:04B01:G06 |
| 82 | 80 | 2914719 | I:2914719:04B02:B05 |

TABLE 2-continued

| SEQ ID NO | CID | Sequence Name | Sample Name or Clone Name |
|---|---|---|---|
| 83 | 81 | 3229778 | I:3229778:02B01:B07 |
| 84 | 109 | 323.B1.sp6__145452 | M00001489B:G04 |
| 85 | 110 | 323.C3.sp6__145466 | M00001496A:G03 |
| 86 | 111 | 324.H1.sp6__145716 | M00001558C:B06 |
| 87 | 121 | 325.H11.sp6__145918 | M00005360A:A07 |
| 88 | 118 | 325.H4.sp6__145911 | M00004031B:D12 |
| 89 | 41 | 344.B2.sp6__146237 | M00022742A:F08 |
| 90 | 139 | 344.C4.sp6__146251 | M00023363C:A04 |
| 91 | 83 | 3518380 | I:3518380:16A01:B07 |
| 92 | 85 | 4072558 | I:4072558:12B01:A07 |
| 93 | 117 | 414.A11.sp6__149879 | M00003961B:H05 |
| 94 | 113 | 414.F2.sp6__149930 | M00001675B:G05 |
| 95 | 87 | 549299 | I:549299:17B02:F06 |
| 96 | 88 | 605019 | I:605019:13B02:D03 |
| 97 | 89 | 620494 | I:620494:16A01:C10 |
| 98 | 125 | 626.D8.sp6__157447 | M00007965C:G08 |
| 99 | 128 | 627.E8.sp6__157651 | M00007987D:D04 |
| 100 | 127 | 627.G6.sp6__157673 | M00007985B:A03 |
| 101 | 129 | 628.D12.sp6__157835 | M00008049B:A12 |
| 102 | 130 | 634.H4.sp6__155966 | M00008099D:A05 |
| 104 | 136 | 642.C6.sp6__156292 | M00022168B:F02 |
| 106 | 5 | 642.D8.sp6__156306 | M00022180D:E11 |
| 107 | 137 | 642.H11.sp6__156357 | M00022215C:A10 |
| 108 | 138 | 653.A3.sp6__158944 | M00023283C:C06 |
| 109 | 141 | 655.B4.sp6__156470 | M00023431B:A01 |
| 110 | 90 | 659143 | I:659143:16B01:E06 |
| 111 | 145 | 661.B5.sp6__159726 | M00027066B:E09 |
| 112 | 91 | 750899 | I:750899:16A01:D04 |
| 113 | 92 | 763607 | I:763607:16A01:E09 |
| 114 | 93 | 901317 | I:901317:16A01:G01 |
| 116 | 100 | 919.H2.SP6__168750 | M00001341B:A11 |
| 118 | 123 | 956.B04.sp6__177996 | M00006883D:H12 |
| 119 | 94 | 956077 | I:956077:14B01:H04 |
| 120 | 95 | 970933 | I:970933:14B01:D03 |
| 121 | 96 | 986558 | I:986558:18A01:C09 |
| 122 | 98 | 998612 | I:998612:14B02:G06 |
| 123 | 103 | A061.ga43__378496 | M00001374A:A06 |
| 124 | 103 | A062.ga43__378497 | M00001374A:A06 |
| 125 | 133 | A121.ga43__378498 | M00022009A:A12 |
| 126 | 133 | A122.ga43__378499 | M00022009A:A12 |
| 130 | 115 | G022a.ga43__378503 | M00003852B:C01 |
| 131 | 106 | RTA00000179AF.k.22.1.Seq | M00001402C:B01 |
| 132 | 113 | RTA00000187AF.g.2.1.Seq | M00001675B:G05 |
| 133 | 113 | RTA00000187AR.g.2.2.Seq | M00001675B:G05 |
| 134 | 106 | RTA00000348R.j.10.1.Seq | M00001402C:B01 |
| 135 | 116 | RTA00000588F.l.02.2.Seq | M00003853B:G11 |
| 136 | 117 | RTA00000588F.o.23.1.Seq | M00003961B:H05 |
| 138 | 123 | RTA00000603F.d.06.1.Seq | M00006883D:H12 |
| 140 | 140 | RTA00000847F.n.19.3.Seq | M00023371A:G03 |
| 141 | 143 | RTA00000922F.g.12.1.Seq | M00026900D:F02 |
| 142 | 121 | RTA00001042F.o.18.1.Seq | M00005360A:A07 |
| 143 | 121 | RTA00001064F.c.16.1.Seq | M00005360A:A07 |
| 144 | 139 | RTA00001069F.c.03.1.Seq | M00023363C:A04 |
| 145 | 112 | RTA00002890F.d.16.1.P.Seq | M00001600C:B11 |
| 147 | 166 | RTA22200002F.b.15.1.P.Seq | M00055435B:A12 |
| 148 | 167 | RTA22200003F.b.13.1.P.Seq | M00055583C:B07 |
| 149 | 169 | RTA22200005F.d.14.1.P.Seq | M00055873C:B06 |
| 150 | 30 | RTA22200007F.j.17.2.P.Seq | M00056227B:G06 |
| 151 | 170 | RTA22200007F.m.02.1.P.Sequence | M00056250C:B02 |
| 152 | 171 | RTA22200008F.a.24.1.P.Seq | M00056301D:A04 |
| 153 | 171 | RTA22200008F.b.01.1.P.Seq | M00056301D:A04 |
| 154 | 172 | RTA22200008F.b.22.1.P.Sequence | M00056308A:F02 |
| 155 | 147 | RTA22200009F.b.03.2.P.Sequence | M00042439D:C11 |
| 156 | 149 | RTA22200009F.c.22.2.P.Seq | M00042756A:H02 |
| 157 | 150 | RTA22200009F.e.10.1.P.Seq | M00042770D:G04 |
| 158 | 151 | RTA22200009F.i.17.2.P.Seq | M00042818A:D05 |
| 159 | 173 | RTA22200009F.p.21.1.P.Seq | M00056350B:B03 |
| 161 | 175 | RTA22200010F.k.02.1.P.Seq | M00056478D:B07 |
| 162 | 176 | RTA22200010F.k.19.1.P.Seq | M00056483D:G07 |
| 163 | 177 | RTA22200010F.m.13.1.P.Seq | M00056500C:A07 |
| 164 | 178 | RTA22200011F.b.05.1.P.Seq | M00056533D:G07 |
| 165 | 179 | RTA22200011F.b.09.1.P.Seq | M00056534C:E08 |
| 166 | 180 | RTA22200011F.g.21.1.P.Seq | M00056585B:F04 |
| 168 | 182 | RTA22200011F.l.06.1.P.Seq | M00056619A:H02 |
| 169 | 183 | RTA22200011F.l.15.1.P.Seq | M00056622B:F12 |
| 170 | 184 | RTA22200011F.m.13.1.P.Seq | M00056632B:H10 |
| 171 | 185 | RTA22200011F.n.24.1.P.Seq | M00056645C:D11 |

TABLE 2-continued

| SEQ ID NO | CID | Sequence Name | Sample Name or Clone Name |
|---|---|---|---|
| 172 | 185 | RTA22200011F.o.01.1.P.Seq | M00056645C:D11 |
| 173 | 186 | RTA22200011F.o.03.1.P.Seq | M00056646B:F07 |
| 174 | 187 | RTA22200012F.c.01.1.P.Seq | M00056679B:H03 |
| 176 | 189 | RTA22200012F.f.15.1.P.Seq | M00056709B:D03 |
| 177 | 190 | RTA22200012F.i.14.1.P.Seq | M00056728C:G02 |
| 179 | 192 | RTA22200013F.b.20.1.P.Seq | M00056810A:A02 |
| 180 | 193 | RTA22200013F.c.06.1.P.Seq | M00056812D:A08 |
| 181 | 194 | RTA22200013F.d.15.1.P.Seq | M00056822A:E08 |
| 182 | 195 | RTA22200013F.o.17.1.P.Seq | M00056908A:H05 |
| 183 | 196 | RTA22200013F.p.24.1.P.Seq | M00056918C:F09 |
| 184 | 197 | RTA22200014F.b.18.1.P.Seq | M00056937C:C10 |
| 185 | 197 | RTA22200014F.b.18.2.P.Seq | M00056937C:C10 |
| 190 | 199 | RTA22200014F.j.08.1.P.Seq | M00056992C:F12 |
| 191 | 199 | RTA22200014F.j.08.2.P.Seq | M00056992C:F12 |
| 192 | 200 | RTA22200015F.a.18.1.P.Seq | M00057044D:G03 |
| 193 | 176 | RTA22200015F.a.23.1.P.Seq | M00057046A:G09 |
| 194 | 201 | RTA22200015F.f.17.1.P.Seq | M00057081B:H03 |
| 196 | 118 | RTA22200015F.k.10.1.P.Seq | M00057112B:E11 |
| 198 | 204 | RTA22200015F.m.15.1.P.Seq | M00057127B:B09 |
| 200 | 206 | RTA22200016F.i.21.1.P.Seq | M00057231A:G04 |
| 201 | 207 | RTA22200016F.k.08.1.P.Seq | M00057241C:F03 |
| 202 | 152 | RTA22200019F.h.04.1.P.Seq | M00054500D:C08 |
| 204 | 151 | RTA22200019F.j.24.1.P.Seq | M00054520A:D04 |
| 205 | 151 | RTA22200019F.k.01.1.P.Seq | M00054520A:D04 |
| 206 | 153 | RTA22200019F.m.05.1.P.Seq | M00054538C:C01 |
| 207 | 154 | RTA22200020F.i.12.1.P.Seq | M00054639D:F05 |
| 208 | 155 | RTA22200020F.j.09.1.P.Seq | M00054647A:A09 |
| 209 | 156 | RTA22200020F.j.24.1.P.Seq | M00054650D:E04 |
| 210 | 157 | RTA22200021F.d.09.2.P.Seq | M00054742C:B12 |
| 211 | 158 | RTA22200021F.g.18.3.P.Seq | M00054769A:E05 |
| 212 | 159 | RTA22200021F.h.15.3.P.Seq | M00054777D:E09 |
| 213 | 160 | RTA22200021F.i.23.3.P.Seq | M00054806B:G03 |
| 214 | 161 | RTA22200022F.d.04.1.P.Seq | M00054893C:D03 |
| 215 | 162 | RTA22200022F.m.09.1.P.Seq | M00054971D:D07 |
| 217 | 195 | RTA22200024F.i.11.1.P.Seq | M00055209C:B07 |
| 218 | 164 | RTA22200024F.p.03.1.P.Seq | M00055258B:D12 |
| 220 | 65 | RTA22200026F.d.17.1.P.Seq | M00055423A:C07 |
| 222 | 124 | RTA22200231F.b.20.1.P.Seq | M00007935D:A05 |
| 223 | 126 | RTA22200231F.l.22.1.P.Seq | M00007985A:B08 |
| 224 | 132 | RTA22200232F.d.23.1.P.Seq | M00021956B:A09 |
| 225 | 291 | RTA22200232F.m.17.1.P.Seq | M00022140A:E11 |
| 226 | 142 | RTA22200241F.e.15.1.P.Seq | M00026888A:A03 |
| 227 | 144 | RTA22200241F.g.22.1.P.Seq | M00026903D:D11 |
| 228 | 115 | X2.ga43__378506 | M00003852B:C01 |
| 230 | 255 | gb\|AA024920.1\|AA024920 | RG:364972:10009:B06 |
| 231 | 262 | gb\|AA033519.1\|AA033519 | RG:471154:10009:H04 |
| 232 | 256 | gb\|AA039790.1\|AA039790 | RG:376554:10009:B12 |
| 233 | 263 | gb\|AA043829.1\|AA043829 | RG:487171:10009:H09 |
| 234 | 265 | gb\|AA070046.1\|AA070046 | RG:530002:10002:A08 |
| 235 | 264 | gb\|AA128438.1\|AA128438 | RG:526536:10002:A02 |
| 236 | 266 | gb\|AA179757.1\|AA179757 | RG:612874:10002:G02 |
| 239 | 269 | gb\|AA232253.1\|AA232253 | RG:666323:10010:B07 |
| 240 | 270 | gb\|AA234451.1\|AA234451 | RG:669110:10010:B12 |
| 242 | 273 | gb\|AA399596.1\|AA399596 | RG:729913:10010:G11 |
| 243 | 276 | gb\|AA400338.1\|AA400338 | RG:742764:10011:A06 |
| 247 | 236 | gb\|AA431134.1\|AA431134 | RG:781507:10011:E01 |
| 248 | 277 | gb\|AA446295.1\|AA446295 | RG:781028:10011:D08 |
| 249 | 278 | gb\|AA448898.1\|AA448898 | RG:785368:10011:E11 |
| 250 | 278 | gb\|AA449542.1\|AA449542 | RG:785846:10011:F02 |
| 252 | 274 | gb\|AA477696.1\|AA477696 | RG:740831:10010:H12 |
| 253 | 280 | gb\|AA530983.1\|AA530983 | RG:985973:10012:B09 |
| 254 | 259 | gb\|AA679027.1\|AA679027 | RG:432960:10009:E11 |
| 255 | 210 | gb\|AA723679.1\|AA723679 | RG:1325847:10012:H07 |
| 256 | 213 | gb\|AA829074.1\|AA829074 | RG:1374447:20004:G01 |
| 257 | 212 | gb\|AA830348.1\|AA830348 | RG:1353123:10013:A06 |
| 258 | 214 | gb\|AA885302.1\|AA885302 | RG:1461567:10013:E03 |
| 260 | 216 | gb\|AA926951.1\|AA926951 | RG:1552386:10013:G04 |
| 262 | 219 | gb\|AI004332.1\|AI004332 | RG:1631867:10014:B06 |
| 263 | 252 | gb\|AI015644.1\|AI015644 | RG:1635546:10014:B08 |
| 264 | 220 | gb\|AI017336.1\|AI017336 | RG:1638979:10014:C04 |
| 265 | 218 | gb\|AI018495.1\|AI018495 | RG:1630930:10014:B05 |
| 266 | 221 | gb\|AI031810.1\|AI031810 | RG:1645945:10014:D05 |
| 267 | 226 | gb\|AI054129.1\|AI054129 | RG:1861510:20001:B03 |
| 268 | 212 | gb\|AI066521.1\|AI066521 | RG:1637619:10014:C02 |
| 269 | 223 | gb\|AI076187.1\|AI076187 | RG:1674098:10014:H01 |
| 270 | 221 | gb\|AI079570.1\|AI079570 | RG:1674393:10014:H02 |
| 271 | 206 | gb\|AI123832.1\|AI123832 | RG:1651303:10014:E01 |

TABLE 2-continued

| SEQ ID NO | CID | Sequence Name | Sample Name or Clone Name |
|---|---|---|---|
| 272 | 225 | gb\|AI207972.1\|AI207972 | RG:1838677:10015:E10 |
| 273 | 231 | gb\|AI224731.1\|AI224731 | RG:2002384:20003:E01 |
| 274 | 233 | gb\|AI265824.1\|AI265824 | RG:2006592:20003:F12 |
| 275 | 232 | gb\|AI279390.1\|AI279390 | RG:2006302:20003:F08 |
| 276 | 227 | gb\|AI298668.1\|AI298668 | RG:1895716:10015:G09 |
| 277 | 229 | gb\|AI305997.1\|AI305997 | RG:1996788:20003:C10 |
| 278 | 230 | gb\|AI306323.1\|AI306323 | RG:1996901:20003:D01 |
| 279 | 239 | gb\|AI335279.1\|AI335279 | RG:2055807:10016:B09 |
| 280 | 238 | gb\|AI336511.1\|AI336511 | RG:2051667:20003:H05 |
| 281 | 228 | gb\|AI347995.1\|AI347995 | RG:1927470:10015:H08 |
| 282 | 235 | gb\|AI356632.1\|AI356632 | RG:2012168:10016:B05 |
| 283 | 237 | gb\|AI375104.1\|AI375104 | RG:2048081:10016:B08 |
| 284 | 241 | gb\|AI421409.1\|AI421409 | RG:2097257:10016:C07 |
| 285 | 242 | gb\|AI421521.1\|AI421521 | RG:2097294:10016:C08 |
| 286 | 243 | gb\|AI523571.1\|AI523571 | RG:2117694:10016:E01 |
| 287 | 258 | gb\|H00135.1\|H00135 | RG:43296:10005:C03 |
| 288 | 261 | gb\|H08424.1\|H08424 | RG:45623:10005:D09 |
| 289 | 260 | gb\|H12948.1\|H12948 | RG:43534:10005:C04 |
| 290 | 236 | gb\|H54104.1\|H54104 | RG:203031:10007:A09 |
| 293 | 246 | gb\|N55598.1\|N55598 | RG:244601:10007:E02 |
| 294 | 245 | gb\|N75655.1\|N75655 | RG:244132:10007:E01 |
| 295 | 248 | gb\|N98702.1\|N98702 | RG:278409:10008:B10 |
| 296 | 129 | gb\|R12138.1\|R12138 | RG:25258:10004:D09 |
| 298 | 2 | gb\|R17980.1\|R17980 | RG:32281:10004:G05 |
| 299 | 254 | gb\|R21293.1\|R21293 | RG:35892:10004:H10 |
| 300 | 249 | gb\|R41558.1\|R41558 | RG:29739:10004:F02 |
| 301 | 2 | gb\|R56713.1\|R56713 | RG:41097:10005:B10 |
| 302 | 224 | gb\|R85309.1\|R85309 | RG:180296:10006:G03 |
| 303 | 222 | gb\|R87679.1\|R87679 | RG:166410:10006:F01 |
| 304 | 208 | gb\|T83145.1\|T83145 | RG:110764:10005:H04 |
| 305 | 250 | gb\|W16960.1\|W16960 | RG:301608:10008:D09 |
| 306 | 251 | gb\|W24201.1\|W24201 | RG:306813:10008:E12 |
| 307 | 252 | gb\|W45587.1\|W45587 | RG:323425:10008:F11 |
| 308 | 253 | gb\|W69496.1\|W69496 | RG:343821:10008:H05 |
| 309 | 257 | gb\|W87460.1\|W87460 | RG:417109:10009:D09 |

Summary of Blast Search Results

Table 3 provides the results of BLASTN searches of the Genbank database using the sequences of the polynucleotides as described above. Table 3 includes 1) the SEQ ID No; 2) the "CID" or Candidate Identification Number to which the sequence is assigned; 3) the GenBank accession number of the Blast hit; 4) a description of the gene encoded by the Blast hit ("HitDesc") having the closest sequence homology to the sequence on the array (and in some instances contains a sequence identical to the sequence on the array); 5) the Blast score ("Score"), which value is obtained by adding the similarities and differences of an alignment between the sequence and a database sequence, wherein a "match" is a positive value and a "mismatch" or "non-match" is a negative value; 6) the "Length" of the sequence, which represents the number of nucleotides in the database "hit"; 7) the Expect value (E) which describes the number of hits or matches "expected" if the database was random sequence, i.e. the E value describes the random background noise that exists for matches between sequences; and 8) the "Identities" ratio which is a ratio of number of bases in the query sequence that exactly match the number of bases in the database sequence when aligned.

TABLE 3

| SEQ ID NO | CID | GenBank Accession No. | HitDesc | Score | Length | Expect | Identities |
|---|---|---|---|---|---|---|---|
| 1 | 114 | D29958 | gi\|473948\|dbj\|D29958.1\|HUMORFA10 Human mRNA for KIAA0116 gene, partial cds | 573 | 1011 | 1E−162 | 289/289 |
| 2 | 123 | NM_020510 | gi\|10048405\|ref\|NM_020510.1\| *Mus musculus* frizzled homolog 10 (*Drosophila*) (Fzd10), mRNA | 77.8 | 2112 | 3E−12 | 39/39 |
| 3 | 114 | D29958 | gi\|473948\|dbj\|D29958.1\|HUMORFA10 Human mRNA for KIAA0116 gene, partial cds | 969 | 1011 | 0 | 559/575 |
| 4 | 1 | XM_001344 | gi\|11421753\|ref\|XM_001344.1\| *Homo sapiens* S100 calcium-binding protein A4 (calcium protein, calvasculin, metastasin, murine placental homolog) (S100A4), mRNA | 464 | 512 | 1E−129 | 234/234 |
| 5 | 2 | NM_004443 | gi\|4758287\|ref\|NM_004443.1\| *Homo sapiens* EphB3 (EPHB3) mRNA | 194 | 3805 | 3E−48 | 137/145 |

TABLE 3-continued

| SEQ ID NO | CID | GenBank Accession No. | HitDesc | Score | Length | Expect | Identities |
|---|---|---|---|---|---|---|---|
| 6 | 3 | BC001014 | gi\|12654380\|gb\|BC001014.1\|BC001014 *Homo sapiens*, Similar to methylenetetrahydrofolate dehydrogenase (NADP+ dependent), methenyltetrahydrofolate cyclohydrolase, formyltetrahydrofolate synthetase, clone IMAGE: 3344724, mRNA, partial cds | 444 | 1378 | 1E−123 | 224/224 |
| 7 | 4 | NM_001363 | gi\|4503336\|ref\|NM_001363.1\| *Homo sapiens* dyskeratosis congenita 1, dyskerin (DKC1), mRNA | 513 | 2422 | 1E−144 | 259/259 |
| 8 | 5 | NM_001699 | gi\|11863124\|ref\|NM_001699.2\| *Homo sapiens* AXL receptor tyrosine kinase (AXL), transcript variant 2, mRNA | 543 | 4986 | 1E−153 | 281/282 |
| 9 | 6 | NM_001827 | gi\|4502858\|ref\|NM_001827.1\| *Homo sapiens* CDC28 protein kinase 2 (CKS2), mRNA | 535 | 627 | 1E−150 | 279/282 |
| 10 | 7 | XM_011126 | gi\|12730374\|ref\|XM_011126.1\| *Homo sapiens* Arg/Abl-interacting protein ArgBP2 (ARGBP2), mRNA | 515 | 2219 | 1E−144 | 260/260 |
| 11 | 8 | BC002718 | gi\|12803760\|gb\|BC002718.1\|BC002718 *Homo sapiens*, type I transmembrane protein Fn14, clone MGC: 3386, mRNA, complete cds | 299 | 1028 | 1E−79 | 223/236 |
| 12 | 9 | XM_007891 | gi\|11430799\|ref\|XM_007891.1\| *Homo sapiens* cadherin 3, type 1, P-cadherin (placental) (CDH3), mRNA | 317 | 3171 | 3E−85 | 160/160 |
| 13 | 10 | BC001883 | gi\|12804870\|gb\|BC001883.1\|BC001883 *Homo sapiens*, nucleolar phosphoprotein p130, clone MGC: 1494, mRNA, complete cds | 490 | 2464 | 1E−137 | 255/259 |
| 14 | 11 | XM_002532 | gi\|11429973\|ref\|XM_002532.1\| *Homo sapiens* 26S proteasome-associated pad1 homolog (POH1), mRNA | 440 | 1132 | 1E−122 | 244/255 |
| 15 | 12 | BC005334 | gi\|13529121\|gb\|BC005334.1\|BC005334 *Homo sapiens*, centrin, EF-hand protein, 2, clone MGC: 12421, mRNA, complete cds | 494 | 1047 | 1E−138 | 258/260 |
| 16 | 13 | XM_009001 | gi\|12742166\|ref\|XM_009001.2\| *Homo sapiens* kallikrein 6 (neurosin, zyme) (KLK6), mRNA | 462 | 1506 | 1E−128 | 233/233 |
| 17 | 14 | XM_005818 | gi\|12735488\|ref\|XM_005818.2\| *Homo sapiens* arachidonate 5-lipoxygenase (ALOX5), mRNA | 373 | 2420 | 1E−102 | 188/188 |
| 18 | 15 | XM_012273 | gi\|12737900\|ref\|XM_012273.1\| *Homo sapiens* forkhead box M1 (FOXM1), mRNA | 396 | 3314 | 1E−109 | 200/200 |
| 19 | 167 | AK000140 | gi\|7020034\|dbj\|AK000140.1\|AK000140 *Homo sapiens* cDNA FLJ20133 fis, clone COL06539 | 1114 | 1403 | 0 | 587/596 |
| 20 | 16 | BC003146 | gi\|13111946\|gb\|BC003146.1\|BC003146 *Homo sapiens*, splicing factor 3b, subunit 3, 130 kD, clone MGC: 3924, mRNA, complete cds | 432 | 1720 | 1E−119 | 218/218 |
| 21 | 17 | BC001763 | gi\|12804676\|gb\|BC001763.1\|BC001763 *Homo sapiens*, Similar to translocase of outer mitochondrial membrane 34, clone MGC: 1252, mRNA, complete cds | 404 | 1917 | 1E−111 | 206/207 |
| 22 | 18 | XM_007326 | gi\|11434291\|ref\|XM_007326.1\| *Homo sapiens* bone morphogenetic protein 4 (BMP4), mRNA | 404 | 1944 | 1E−111 | 204/204 |
| 23 | 19 | XM_005376 | gi\|12734932\|ref\|XM_005376.2\| *Homo sapiens* Friedreich ataxia (FRDA), mRNA | 371 | 1503 | 1E−101 | 192/194 |
| 24 | 20 | XM_010945 | gi\|12729201\|ref\|XM_010945.1\| *Homo sapiens* hypothetical gene supported by XM_010945 (LOC65371), mRNA | 452 | 614 | 1E−125 | 228/228 |
| 25 | 21 | AK018953 | gi\|12858931\|dbj\|AK018953.1\|AK018953 *Mus musculus* adult male testis cDNA, RIKEN full-length enriched library, clone: 1700111D04, full insert sequence | 174 | 1297 | 5E−42 | 174/203 |
| 26 | 22 | BC003635 | gi\|13177711\|gb\|BC003635.1\|BC003635 *Homo sapiens*, matrix metalloproteinase 7 (matrilysin, uterine), clone MGC: 3913, mRNA, complete cds | 456 | 1140 | 1E−127 | 230/230 |

TABLE 3-continued

| SEQ ID NO | CID | GenBank Accession No. | HitDesc | Score | Length | Expect | Identities |
|---|---|---|---|---|---|---|---|
| 27 | 23 | XM_008589 | gi|11427373|ref|XM_008589.1| Homo sapiens pyrroline-5-carboxylate reductase 1 (PYCR1), mRNA | 440 | 1790 | 1E-122 | 224/225 |
| 28 | 24 | BC001880 | gi|12804864|gb|BC001880.1|BC001880 Homo sapiens, Similar to insulin induced gene 1, clone MGC: 1405, mRNA, complete cds | 379 | 1469 | 1E-103 | 191/191 |
| 29 | 25 | XM_003047 | gi|12729625|ref|XM_003047.2| Homo sapiens minichromosome maintenance deficient (S. cerevisiae) 2 (mitotin) (MCM2), mRNA | 353 | 3383 | 7E-96 | 178/178 |
| 30 | 26 | NC_002548 | gi|10314009|ref|NC_002548.1| Acute bee paralysis virus, complete genome | 38.2 | 9491 | 0.68 | 19/19 |
| 31 | 170 | NM_004219 | gi|11038651|ref|NM_004219.2| Homo sapiens pituitary tumor-transforming 1 (PTTG1), mRNA | 1314 | 728 | 0 | 667/669 |
| 32 | 27 | BC002479 | gi|12803322|gb|BC002479.1|BC002479 Homo sapiens, cathepsin H, clone MGC: 1519, mRNA, complete cds | 613 | 1479 | 1E-174 | 309/309 |
| 33 | 28 | BC000123 | gi|12652744|gb|BC000123.1|BC000123 Homo sapiens, pyridoxal (pyridoxine, vitamin B6) kinase, clone MGC: 3128, mRNA, complete cds | 545 | 1331 | 1E-153 | 275/275 |
| 34 | 29 | AK000836 | gi|7021154|dbj|AK000836.1|AK000836 Homo sapiens cDNA FLJ20829 fis, clone ADKA03163, highly similar to D26488 Human mRNA for KIAA0007 gene | 406 | 1703 | 1E-112 | 205/205 |
| 35 | 30 | BC001425 | gi|12655140|gb|BC001425.1|BC001425 Homo sapiens, Similar to differential display and activated by p53, clone MGC: 1780, mRNA, complete cds | 504 | 2499 | 1E-141 | 256/257 |
| 36 | 31 | BC005301 | gi|13529028|gb|BC005301.1|BC005301 Homo sapiens, integrin beta 3 binding protein (beta3-endonexin), clone MGC: 12370, mRNA, complete cds | 442 | 998 | 1E-122 | 225/226 |
| 37 | 32 | Z27409 | gi|482916|emb|Z27409.1|HSRTKEPH H. sapiens mRNA for receptor tyrosine kinase eph (partial) | 529 | 2398 | 1E-149 | 276/278 |
| 38 | 33 | XM_003107 | gi|12729732|ref|XM_003107.2| Homo sapiens transketolase (Wernicke-Korsakoff syndrome) (TKT), mRNA | 436 | 1985 | 1E-120 | 227/228 |
| 39 | 34 | AB002297 | gi|2224538|dbj|AB002297.1|AB002297 Human mRNA for KIAA0299 gene, partial cds | 387 | 8063 | 1E-106 | 208/211 |
| 40 | 35 | XM_002591 | gi|12728749|ref|XM_002591.2| Homo sapiens KIAA0173 gene product (KIAA0173), mRNA | 502 | 4732 | 1E-140 | 253/253 |
| 41 | 36 | XM_009101 | gi|11425196|ref|XM_009101.1| Homo sapiens fucosyltransferase 1 (galactoside 2-alpha-L-fucosyltransferase, Bombay phenotype included) (FUT1), mRNA | 523 | 3374 | 1E-147 | 271/272 |
| 42 | 37 | AF082858 | gi|4587463|gb|AF082858.1|AF082858 Homo sapiens pterin carbinolamine dehydratase (PCD) mRNA, complete cds | 494 | 829 | 1E-138 | 249/249 |
| 43 | 38 | BC001600 | gi|12804396|gb|BC001600.1|BC001600 Homo sapiens, D123 gene product, clone MGC: 1935, mRNA, complete cds | 533 | 1316 | 1E-150 | 269/269 |
| 44 | 39 | BC000871 | gi|12654114|gb|BC000871.1|BC000871 Homo sapiens, annexin A3, clone MGC: 5043, mRNA, complete cds | 609 | 1489 | 1E-172 | 307/307 |
| 45 | 41 | AL136600 | gi|13276700|emb|AL136600.1|HSM801574 Homo sapiens mRNA; cDNA DKFZp564I1216 (from clone DKFZp564I1216); complete cds | 504 | 1552 | 1E-141 | 254/254 |
| 46 | 42 | AK024772 | gi|10437149|dbj|AK024772.1|AK024772 Homo sapiens cDNA: FLJ21119 fis, clone CAS05644, highly similar to HSA272196 Homo sapiens mRNA for hypothetical protein | 484 | 864 | 1E-135 | 246/247 |
| 47 | 43 | BC004246 | gi|13279007|gb|BC004246.1|BC004246 Homo sapiens, mutS (E. coli) homolog 6, clone MGC: 10498, mRNA, complete cds | 438 | 4249 | 1E-121 | 221/221 |

TABLE 3-continued

| SEQ ID NO | CID | GenBank Accession No. | HitDesc | Score | Length | Expect | Identities |
|---|---|---|---|---|---|---|---|
| 48 | 44 | X92474 | gi\|1045056\|emb\|X92474.1\|HSCHTOG H. sapiens mRNA for ch-TOG protein | 238 | 6449 | 2E-61 | 122/123 |
| 49 | 45 | BC002994 | gi\|12804270\|gb\|BC002994.1\|BC002994 Homo sapiens, clone MGC: 3823, mRNA, complete cds | 476 | 2238 | 1E-132 | 246/248 |
| 50 | 46 | AK025062 | gi\|10437501\|dbj\|AK025062.1\|AK025062 Homo sapiens cDNA: FLJ21409 fis, clone COL03924 | 327 | 2692 | 4E-88 | 174/176 |
| 51 | 47 | AP001247 | gi\|10121151\|dbj\|AP001247.3\|AP001247 Homo sapiens genomic DNA, chromosome 2p11.2, clone: lambda316 | 36.2 | 16950 | 2.8 | 20/21 |
| 52 | 48 | AF131838 | gi\|4406677\|gb\|AF131838.1\|AF131838 Homo sapiens clone 25107 mRNA sequence | 498 | 1462 | 1E-139 | 251/251 |
| 53 | 49 | XM_007647 | gi\|11432476\|ref\|XM_007647.1\| Homo sapiens immunoglobulin superfamily containing leucine-rich repeat (ISLR), mRNA | 531 | 2111 | 1E-149 | 268/268 |
| 54 | 50 | AB048286 | gi\|13537296\|dbj\|AB048286.1\|AB048286 Homo sapiens GS1999full mRNA, complete cds | 476 | 2713 | 1E-132 | 247/248 |
| 56 | 53 | AK001515 | gi\|7022818\|dbj\|AK001515.1\|AK001515 Homo sapiens cDNA FLJ10653 fis, clone NT2RP2005890 | 333 | 884 | 6E-90 | 168/168 |
| 57 | 54 | AB023156 | gi\|4589521\|dbj\|AB023156.1\|AB023156 Homo sapiens mRNA for KIAA0939 protein, partial cds | 42.1 | 5537 | 0.055 | 24/25 |
| 58 | 55 | XM_008622 | gi\|12740774\|ref\|XM_008622.2\| Homo sapiens thymidine kinase 1, soluble (TK1), mRNA | 507 | 1427 | 1E-142 | 256/256 |
| 59 | 56 | XM_003758 | gi\|11416585\|ref\|XM_003758.1\| Homo sapiens transforming growth factor, beta-induced, 68 kD (TGFBI), mRNA | 422 | 2691 | 1E-116 | 215/216 |
| 60 | 58 | XM_001732 | gi\|11423748\|ref\|XM_001732.1\| Homo sapiens calcyclin binding protein (CACYBP), mRNA | 500 | 2435 | 1E-140 | 252/252 |
| 61 | 59 | BC001866 | gi\|12804840\|gb\|BC001866.1\|BC001866 Homo sapiens, replication factor C (activator 1) 5 (36.5 kD), clone MGC: 1155, mRNA, complete cds | 396 | 2097 | 1E-109 | 239/256 |
| 62 | 60 | BC000293 | gi\|12653056\|gb\|BC000293.1\|BC000293 Homo sapiens, non-metastatic cells 1, protein (NM23A) expressed in, clone MGC: 8334, mRNA, complete cds | 87.7 | 733 | 2E-16 | 58/65 |
| 63 | 63 | XM_008043 | gi\|12739769\|ref\|XM_008043.2\| Homo sapiens dipeptidase 1 (renal) (DPEP1), mRNA | 519 | 1739 | 1E-146 | 262/262 |
| 64 | 64 | AB052751 | gi\|11967903\|dbj\|AB052751.1\|AB052751 Homo sapiens Axin2 mRNA for conductin, partial cds and 3'UTR | 527 | 1863 | 1E-148 | 266/266 |
| 65 | 65 | BC005832 | gi\|13543336\|gb\|BC005832.1\|BC005832 Homo sapiens, KIAA0101 gene product, clone MGC: 2250, mRNA, complete cds | 460 | 1444 | 1E-128 | 232/232 |
| 66 | 66 | XM_002190 | gi\|11428365\|ref\|XM_002190.1\| Homo sapiens chromosome 1 open reading frame 2 (C1ORF2), mRNA | 472 | 3152 | 1E-131 | 238/238 |
| 67 | 67 | XM_010360 | gi\|12743462\|ref\|XM_010360.2\| Homo sapiens transcription factor NRF (NRF), mRNA | 505 | 3746 | 1E-141 | 255/255 |
| 68 | 68 | AL122064 | gi\|6102857\|emb\|AL122064.1\|HSM801208 Homo sapiens mRNA; cDNA DKFZp434M231 (from clone DKFZp434M231); partial cds | 502 | 1320 | 1E-140 | 257/259 |
| 70 | 71 | XM_005226 | gi\|11425871\|ref\|XM_005226.1\| Homo sapiens antizyme inhibitor (LOC51582), mRNA | 507 | 2619 | 1E-142 | 256/256 |
| 71 | 74 | BC002956 | gi\|12804196\|gb\|BC002956.1\|BC002956 Homo sapiens, ClpP (caseinolytic protease, ATP-dependent, proteolytic subunit, E. coli homolog, clone MGC: 1379, mRNA, complete cds | 484 | 1185 | 1E-135 | 244/244 |
| 73 | 100 | NM_014791 | gi\|7661973\|ref\|NM_014791.1\| Homo sapiens KIAA0175 gene product (KIAA0175), mRNA | 1211 | 2470 | 0 | 691/708 |

TABLE 3-continued

| SEQ ID NO | CID | GenBank Accession No. | HitDesc | Score | Length | Expect | Identities |
|---|---|---|---|---|---|---|---|
| 74 | 105 | BC005864 | gi\|13543414\|gb\|BC005864.1\|BC005864 *Homo sapiens*, cyclin-dependent kinase 4, clone MGC: 3719, mRNA, complete cds | 1108 | 1430 | 0 | 621/635 |
| 75 | 106 | XM_005404 | gi\|11428250\|ref\|XM_005404.1\| *Homo sapiens* catenin (cadherin-associated protein), alpha-like 1 (CTNNAL1), mRNA | 1203 | 2446 | 0 | 631/638 |
| 76 | 104 | BC002362 | gi\|12803116\|gb\|BC002362.1\|BC002362 *Homo sapiens*, lactate dehydrogenase B, clone MGC: 8627, mRNA, complete cds | 1269 | 1318 | 0 | 643/644 |
| 77 | 75 | AF065389 | gi\|3152702\|gb\|AF065389.1\|AF065389 *Homo sapiens* tetraspan NET-4 mRNA, complete cds | 434 | 1405 | 1E−120 | 236/244 |
| 78 | 76 | BC004863 | gi\|13436073\|gb\|BC004863.1\|BC004863 *Homo sapiens*, Similar to phosphoserine aminotransferase, clone MGC: 10519, mRNA, complete cds | 587 | 2229 | 1E−166 | 303/304 |
| 79 | 77 | XM_011917 | gi\|12735709\|ref\|XM_011917.1\| *Homo sapiens* adenosine kinase (ADK), mRNA | 509 | 1414 | 1E−143 | 259/260 |
| 80 | 78 | BC000897 | gi\|12654158\|gb\|BC000897.1\|BC000897 *Homo sapiens*, interferon induced transmembrane protein 1 (9-27), clone MGC: 5195, mRNA, complete cds | 143 | 683 | 8E−33 | 102/107 |
| 81 | 79 | NM_014641 | gi\|7661965\|ref\|NM_014641.1\| *Homo sapiens* KIAA0170 gene product (KIAA0170), mRNA | 335 | 6940 | 3E−90 | 196/206 |
| 82 | 80 | XM_012967 | gi\|12742527\|ref\|XM_012967.1\| *Homo sapiens* RAE1 (RNA export 1, S. pombe) homolog (RAE1), mRNA | 430 | 1188 | 1E−119 | 231/233 |
| 83 | 81 | XM_003913 | gi\|12719136\|ref\|XM_003913.2\| *Homo sapiens* integrin, alpha 2 (CD49B, alpha 2 subunit of VLA-2 receptor) (ITGA2), mRNA | 571 | 5348 | 1E−161 | 288/288 |
| 84 | 109 | AK024039 | gi\|10436304\|dbj\|AK024039.1\|AK024039 *Homo sapiens* cDNA FLJ13977 fis, clone Y79AA1001603, weakly similar to POLYPEPTIDE N-ACETYLGALACTOSAMINYLTRANSFERASE (EC 2.4.1.41) | 422 | 2224 | 1E−116 | 377/443 |
| 85 | 110 | XM_009492 | gi\|11420665\|ref\|XM_009492.1\| *Homo sapiens* v-myb avian myeloblastosis viral oncogene homolog-like 2 (MYBL2), mRNA | 852 | 2627 | 0 | 440/444 |
| 86 | 111 | XM_009587 | gi\|12742401\|ref\|XM_009587.2\| *Homo sapiens* TH1 *drosophila* homolog (HSPC130), mRNA | 749 | 2108 | 0 | 392/394 |
| 87 | 121 | NM_001408 | gi\|13325063\|ref\|NM_001408.1\| *Homo sapiens* cadherin, EGF LAG seven-pass G-type receptor 2, flamingo (*Drosophila*) homolog (CELSR2), mRNA | 1067 | 10531 | 0 | 627/660 |
| 88 | 118 | AF226998 | gi\|12655885\|gb\|AF226998.1\|AF226998 *Homo sapiens* dpy-30-like protein mRNA, complete cds | 775 | 734 | 0 | 391/391 |
| 89 | 41 | BC001106 | gi\|12654544\|gb\|BC001106.1\|BC001106 *Homo sapiens*, hypothetical protein, clone MGC: 891, mRNA, complete cds | 416 | 1542 | 1E−114 | 214/216 |
| 90 | 139 | XM_009005 | gi\|11424670\|ref\|XM_009005.1\| *Homo sapiens* kallikrein 11 (KLK11), mRNA | 1112 | 1186 | 0 | 617/630 |
| 91 | 83 | XM_006067 | gi\|12736004\|ref\|XM_006067.2\| *Homo sapiens* 7-dehydrocholesterol reductase (DHCR7), mRNA | 321 | 2525 | 4E−86 | 189/194 |
| 92 | 85 | AF092569 | gi\|3986473\|gb\|AF092569.1\|HSEIFP1 *Homo sapiens* translation initiation factor eIF3 p40 subunit gene, exon 1 | 87.7 | 299 | 2E−16 | 74/79 |
| 93 | 117 | BC004264 | gi\|13279061\|gb\|BC004264.1\|BC004264 *Homo sapiens*, Similar to EphB4, clone IMAGE: 3611312, mRNA, partial cds | 1021 | 3138 | 0 | 564/582 |
| 94 | 113 | BC000277 | gi\|12802987\|gb\|BC000277.1\|BC000277 *Homo sapiens*, clone MGC: 1892, mRNA, complete cds | 1011 | 2947 | 0 | 586/618 |
| 95 | 87 | NM_015339 | gi\|12229216\|ref\|NM_015339.1\| *Homo sapiens* activity-dependent neuroprotective protein (ADNP), mRNA | 599 | 4713 | 1E−169 | 302/302 |

TABLE 3-continued

| SEQ ID NO | CID | GenBank Accession No. | HitDesc | Score | Length | Expect | Identities |
|---|---|---|---|---|---|---|---|
| 96 | 88 | XM_009845 | gi|11526339|ref|XM_009845.1| Homo sapiens catechol-O-methyltransferase (COMT), mRNA | 505 | 1291 | 1E-141 | 255/255 |
| 97 | 89 | BC000509 | gi|12653474|gb|BC000509.1|BC000509 Homo sapiens, proteasome (prosome, macropain) subunit, beta type, 7, clone MGC: 8507, mRNA, complete cds | 517 | 1008 | 1E-145 | 261/261 |
| 98 | 125 | AK024618 | gi|10436934|dbj|AK024618.1|AK024618 Homo sapiens cDNA: FLJ20965 fis, clone ADSH01104 | 1199 | 1804 | 0 | 662/676 |
| 99 | 128 | D80001 | gi|1136417|dbj|D80001.1|D80001 Human mRNA for KIAA0179 gene, partial cds | 1138 | 4994 | 0 | 639/663 |
| 100 | 127 | BC004899 | gi|13436169|gb|BC004899.1|BC004899 Homo sapiens, sigma receptor (SR31747 binding protein 1), clone MGC: 3851, mRNA, complete cds | 930 | 1688 | 0 | 579/619 |
| 101 | 129 | BC003129 | gi|13111916|gb|BC003129.1|BC003129 Homo sapiens, non-POU-domain-containing, octamer-binding, clone MGC: 3380, mRNA, complete cds | 1043 | 1882 | 0 | 583/602 |
| 102 | 130 | XM_009690 | gi|12742251|ref|XM_009690.2| Homo sapiens hypothetical protein FLJ10850 (FLJ10850), mRNA | 438 | 2277 | 1E-121 | 367/404 |
| 104 | 136 | XM_005908 | gi|11432093|ref|XM_005908.1| Homo sapiens hypothetical protein FLJ10540 (FLJ10540), mRNA | 1235 | 2237 | 0 | 642/646 |
| 106 | 5 | NM_001699 | gi|11863124|ref|NM_001699.2| Homo sapiens AXL receptor tyrosine kinase (AXL), transcript variant 2, mRNA | 922 | 4986 | 0 | 550/572 |
| 107 | 137 | NM_025927 | gi|13385417|ref|NM_025927.1| Mus musculus RIKEN cDNA 2600005P05 gene (2600005P05Rik), mRNA | 228 | 1486 | 1E-57 | 223/259 |
| 108 | 138 | AK023154 | gi|10434948|dbj|AK023154.1|AK023154 Homo sapiens cDNA FLJ13092 fis, clone NT2RP3002147 | 924 | 3040 | 0 | 524/541 |
| 109 | 141 | AB017710 | gi|5821114|dbj|AB017710.1|AB017710 Homo sapiens U50HG genes for U50' snoRNA and U50 snoRNA, complete sequence | 1067 | 2353 | 0 | 570/582 |
| 110 | 90 | NM_011775 | gi|6756080|ref|NM_011775.1| Mus musculus zona pellucida glycoprotein 2 (Zp2), mRNA | 40.1 | 2185 | 0.21 | 20/20 |
| 111 | 145 | AF086315 | gi|3483660|gb|AF086315.1|HUMZD52F10 Homo sapiens full length insert cDNA clone ZD52F10 | 841 | 600 | 0 | 467/480 |
| 112 | 91 | XM_002596 | gi|12728741|ref|XM_002596.2| Homo sapiens protein tyrosine phosphatase, receptor type, N (PTPRN), mRNA | 361 | 2877 | 4E-98 | 201/209 |
| 113 | 92 | XM_004484 | gi|11418942|ref|XM_004484.1| Homo sapiens tumor protein D52-like 1 (TPD52L1), mRNA | 482 | 1325 | 1E-134 | 243/243 |
| 114 | 93 | BC000331 | gi|12653128|gb|BC000331.1|BC000331 Homo sapiens, proteasome (prosome, macropain) subunit, beta type, 4, clone MGC: 8522, mRNA, complete cds | 583 | 935 | 1E-165 | 305/310 |
| 116 | 100 | NM_014791 | gi|7661973|ref|NM_014791.1| Homo sapiens KIAA0175 gene product (KIAA0175), mRNA | 1185 | 2470 | 0 | 644/664 |
| 118 | 123 | XM_004185 | gi|12731991|ref|XM_004185.2| Homo sapiens valyl-tRNA synthetase 2 (VARS2), mRNA | 751 | 4092 | 0 | 463/481 |
| 119 | 94 | XM_004750 | gi|12733059|ref|XM_004750.2| Homo sapiens nudix (nucleoside diphosphate linked moiety X)-type motif 1 (NUDT1), mRNA | 484 | 629 | 1E-135 | 244/244 |
| 120 | 95 | XM_006928 | gi|12737727|ref|XM_006928.2| Homo sapiens FOXJ2 forkhead factor (LOC55810), mRNA | 412 | 4870 | 1E-113 | 239/248 |
| 121 | 96 | AL133104 | gi|6453587|emb|AL133104.1|HSM801384 Homo sapiens mRNA; cDNA DKFZp434E1822 (from clone DKFZp434E1822); partial cds | 601 | 1186 | 1E-170 | 303/303 |

TABLE 3-continued

| SEQ ID NO | CID | GenBank Accession No. | HitDesc | Score | Length | Expect | Identities |
|---|---|---|---|---|---|---|---|
| 122 | 98 | BC004528 | gi\|1358647\|gb\|BC004528.1\|BC004528 Homo sapiens, clone MGC: 3017, mRNA, complete cds | 466 | 2751 | 1E-129 | 244/246 |
| 123 | 103 | AF097514 | gi\|4808600\|gb\|AF097514.1\|AF097514 Homo sapiens stearoyl-CoA desaturase (SCD) mRNA, complete cds | 1302 | 5221 | 0 | 721/738 |
| 124 | 103 | AF097514 | gi\|4808600\|gb\|AF097514.1\|AF097514 Homo sapiens stearoyl-CoA desaturase (SCD) mRNA, complete cds | 1328 | 5221 | 0 | 720/734 |
| 125 | 133 | AF220656 | gi\|7107358\|gb\|AF220656.1\|AF220656 Homo sapiens apoptosis-associated nuclear protein PHLDA1 (PHLDA1) mRNA, partial cds | 936 | 3227 | 0 | 529/539 |
| 126 | 133 | AF220656 | gi\|7107358\|gb\|AF220656.1\|AF220656 Homo sapiens apoptosis-associated nuclear protein PHLDA1 (PHLDA1) mRNA, partial cds | 969 | 3227 | 0 | 544/555 |
| 130 | 115 | AF019770 | gi\|2674084\|gb\|AF019770.1\|AF019770 Homo sapiens macrophage inhibitory cytokine-1 (MIC-1) mRNA, complete cds | 1277 | 1202 | 0 | 735/751 |
| 131 | 106 | AK022926 | gi\|10434597\|dbj\|AK022926.1\|AK022926 Homo sapiens cDNA FLJ12864 fis, clone NT2RP2003604, highly similar to Homo sapiens alpha-catenin-like protein (CTNNAL1) mRNA | 589 | 2455 | 1E-166 | 299/300 |
| 132 | 113 | BC000277 | gi\|12802987\|gb\|BC000277.1\|BC000277 Homo sapiens, clone MGC: 1892, mRNA, complete cds | 513 | 2947 | 1E-144 | 262/263 |
| 133 | 113 | XM_006213 | gi\|12736410\|ref\|XM_006213.2\| Homo sapiens KIAA0712 gene product (KIAA0712), mRNA | 579 | 6477 | 1E-163 | 299/300 |
| 134 | 106 | XM_005404 | gi\|11428250\|ref\|XM_005404.1\| Homo sapiens catenin (cadherin-associated protein), alpha-like 1 (CTNNAL1), mRNA | 561 | 2446 | 1E-158 | 300/306 |
| 135 | 116 | BC001068 | gi\|12654476\|gb\|BC001068.1\|BC001068 Homo sapiens, clone IMAGE: 2823731, mRNA, partial cds | 595 | 2333 | 1E-168 | 300/300 |
| 136 | 117 | BC004264 | gi\|13279061\|gb\|BC004264.1\|BC004264 Homo sapiens, Similar to EphB4, clone IMAGE: 3611312, mRNA, partial cds | 486 | 3138 | 1E-135 | 250/252 |
| 138 | 123 | Y09668 | gi\|1834428\|emb\|Y09668.1\|DRTKLELF1 D. rerio mRNA for tyrosine kinase ligand (elf-1) | 36.2 | 2272 | 3.5 | 18/18 |
| 140 | 140 | XM_008802 | gi\|12741169\|ref\|XM_008802.2\| Homo sapiens retinoblastoma-binding protein 8 (RBBP8), mRNA | 710 | 3185 | 0 | 358/358 |
| 141 | 143 | XM_009111 | gi\|12741675\|ref\|XM_009111.2\| Homo sapiens sulfotransferase family, cytosolic, 2B, member 1 (SULT2B1), mRNA | 672 | 1453 | 0 | 362/367 |
| 142 | 121 | NM_001408 | gi\|13325063\|ref\|NM_001408.1\| Homo sapiens cadherin, EGF LAG seven-pass G-type receptor 2, flamingo (Drosophila) homolog (CELSR2), mRNA | 755 | 10531 | 0 | 388/389 |
| 143 | 121 | NM_001408 | gi\|13325063\|ref\|NM_001408.1\| Homo sapiens cadherin, EGF LAG seven-pass G-type receptor 2, flamingo (Drosophila) homolog (CELSR2), mRNA | 741 | 10531 | 0 | 376/377 |
| 144 | 139 | XM_009005 | gi\|11424670\|ref\|XM_009005.1\| Homo sapiens kallikrein 11 (KLK11), mRNA | 622 | 1186 | 1E-176 | 340/346 |
| 145 | 112 | XM_003733 | gi\|12731080\|ref\|XM_003733.2\| Homo sapiens DEAD-box protein abstrakt (ABS), mRNA | 753 | 2088 | 0 | 380/380 |
| 147 | 166 | AF216754 | gi\|6707650\|gb\|AF216754.1\|AF216754 Homo sapiens over-expressed breast tumor protein (OBTP) mRNA, complete cds | 567 | 354 | 1E-160 | 296/298 |
| 148 | 167 | XM_003384 | gi\|12730453\|ref\|XM_003384.2\| Homo sapiens hypothetical protein (LOC51316), mRNA | 640 | 748 | 0 | 323/323 |

TABLE 3-continued

| SEQ ID NO | CID | GenBank Accession No. | HitDesc | Score | Length | Expect | Identities |
|---|---|---|---|---|---|---|---|
| 149 | 169 | XM_009527 | gi\|11420875\|ref\|XM_009527.1\| *Homo sapiens* secretory leukocyte protease inhibitor (antileukoproteinase) (SLPI), mRNA | 751 | 594 | 0 | 382/383 |
| 150 | 30 | AF279897 | gi\|12751120\|gb\|AF279897.1\|AF279897 *Homo sapiens* PNAS-143 mRNA, complete cds | 654 | 727 | 0 | 333/334 |
| 151 | 170 | NM_004219 | gi\|11038651\|ref\|NM_004219.2\| *Homo sapiens* pituitary tumor-transforming 1 (PTTG1), mRNA | 730 | 728 | 0 | 368/368 |
| 152 | 171 | S76771 | gi\|914225\|gb\|S76771.1\|S76771 TPO = thrombopoietin [human, Genomic, 6849 nt] | 210 | 6849 | 1E−52 | 168/185 |
| 153 | 171 | M81890 | gi\|186274\|gb\|M81890.1\|HUMIL11A Human interleukin 11 (IL11) gene, complete mRNA | 216 | 6870 | 2E−54 | 180/203 |
| 154 | 172 | XM_004952 | gi\|12733392\|ref\|XM_004952.2\| *Homo sapiens* solute carrier family 26, member 3 (SLC26A3), mRNA | 603 | 2861 | 1E−171 | 310/312 |
| 155 | 147 | XM_009488 | gi\|12742285\|ref\|XM_009488.2\| *Homo sapiens* ubiquitin carrier protein E2-C (UBCH10), mRNA | 716 | 770 | 0 | 361/361 |
| 156 | 149 | XM_011755 | gi\|12734624\|ref\|XM_011755.1\| *Homo sapiens* SET translocation (myeloid leukemia-associated) (SET), mRNA | 733 | 2566 | 0 | 370/370 |
| 157 | 150 | L19183 | gi\|307154\|gb\|L19183.1\|HUMMAC30X Human MAC30 mRNA, 3' end | 593 | 2002 | 1E−168 | 323/331 |
| 158 | 151 | AK024303 | gi\|10436651\|dbj\|AK024303.1\|AK024303 *Homo sapiens* cDNA FLJ14241 fis, clone OVARC1000533 | 698 | 1591 | 0 | 352/352 |
| 159 | 173 | BC001410 | gi\|12655116\|gb\|BC001410.1\|BC001410 *Homo sapiens*, S100 calcium-binding protein A11 (calgizzarin), clone MGC: 2149, mRNA, complete cds | 682 | 577 | 0 | 354/356 |
| 161 | 175 | BC001308 | gi\|12654922\|gb\|BC001308.1\|BC001308 *Homo sapiens*, clone HQ0310 PRO0310p1, clone MGC: 5505, mRNA, complete cds | 646 | 2263 | 0 | 353/362 |
| 162 | 176 | XM_009004 | gi\|12742171\|ref\|XM_009004.2\| *Homo sapiens* kallikrein 10 (KLK10), mRNA | 458 | 1448 | 1E−127 | 231/231 |
| 163 | 177 | XM_006705 | gi\|12737366\|ref\|XM_006705.2\| *Homo sapiens* nascent-polypeptide-associated complex alpha polypeptide (NACA), mRNA | 630 | 784 | 1E−179 | 324/326 |
| 164 | 178 | AF102848 | gi\|12641918\|gb\|AF102848.1\|AF102848 *Homo sapiens* keratin 23 (KRT23) mRNA, complete cds | 739 | 1649 | 0 | 379/381 |
| 165 | 179 | XM_003512 | gi\|12730699\|ref\|XM_003512.2\| *Homo sapiens* amphiregulin (schwannoma-derived growth factor) (AREG), mRNA | 718 | 1231 | 0 | 371/374 |
| 166 | 180 | XM_005313 | gi\|12734542\|ref\|XM_005313.2\| *Homo sapiens* gamma-glutamyl hydrolase (conjugase, folylpolygammaglutamyl hydrolase) (GGH), mRNA | 652 | 1275 | 0 | 335/337 |
| 168 | 182 | XM_010117 | gi\|11419764\|ref\|XM_010117.1\| *Homo sapiens* plastin 3 (T isoform) (PLS3), mRNA | 690 | 2519 | 0 | 360/364 |
| 169 | 183 | L47277 | gi\|986911\|gb\|L47277.1\|HUMTOPATRA *Homo sapiens* (cell line HepG2, HeLa) alpha topoisomerase truncated-form mRNA, 3'UTR | 646 | 994 | 0 | 353/362 |
| 170 | 184 | XM_012941 | gi\|12742342\|ref\|XM_012941.1\| *Homo sapiens* chromosome 20 open reading frame 1 (C20ORF1), mRNA | 670 | 3071 | 0 | 341/342 |
| 171 | 185 | NM_000581 | gi\|10834975\|ref\|NM_000581.1\| *Homo sapiens* glutathione peroxidase 1 (GPX1), mRNA | 640 | 1134 | 0 | 339/343 |
| 172 | 185 | NM_000581 | gi\|10834975\|ref\|NM_000581.1\| *Homo sapiens* glutathione peroxidase 1 (GPX1), mRNA | 640 | 1134 | 0 | 338/343 |
| 173 | 186 | X06705 | gi\|35511\|emb\|X06705.1\|HSPLAX Human PLA-X mRNA | 700 | 883 | 0 | 353/353 |

TABLE 3-continued

| SEQ ID NO | CID | GenBank Accession No. | HitDesc | Score | Length | Expect | Identities |
|---|---|---|---|---|---|---|---|
| 174 | 187 | D45915 | gi\|1483130\|dbj\|D45915.1\|D45915 Human mRNA for p80 protein, complete cds | 666 | 2584 | 0 | 336/336 |
| 176 | 189 | BC000242 | gi\|12652962\|gb\|BC000242.1\|BC000242 Homo sapiens, CGI-138 protein, clone MGC: 676, mRNA, complete cds | 521 | 849 | 1E−146 | 280/286 |
| 177 | 190 | BC005945 | gi\|13543585\|gb\|BC005945.1\|BC005945 Homo sapiens, MAD2 (mitotic arrest deficient, yeast, homolog)-like 1, clone MGC: 14577, mRNA, complete cds | 567 | 1391 | 1E−160 | 295/298 |
| 179 | 192 | XM_010835 | gi\|12728550\|ref\|XM_010835.1\| Homo sapiens similar to hypothetical protein (H. sapiens) (LOC65349), mRNA | 452 | 1679 | 1E−125 | 313/340 |
| 180 | 193 | XM_009475 | gi\|11420562\|ref\|XM_009475.1\| Homo sapiens S-adenosylhomocysteine hydrolase (AHCY), mRNA | 668 | 2110 | 0 | 340/341 |
| 181 | 194 | AF054183 | gi\|4092053\|gb\|AF054183.1\|AF054183 Homo sapiens GTP binding protein mRNA, complete cds | 690 | 1148 | 0 | 351/352 |
| 182 | 195 | BC005356 | gi\|13529175\|gb\|BC005356.1\|BC005356 Homo sapiens, Similar to hypothetical protein MGC3077, clone MGC: 12457, mRNA, complete cds | 396 | 1050 | 1E−108 | 200/200 |
| 183 | 196 | XM_006545 | gi\|12736918\|ref\|XM_006545.2\| Homo sapiens hypothetical protein (HSPC152), mRNA | 613 | 588 | 1E−173 | 309/309 |
| 184 | 197 | XM_003598 | gi\|12730828\|ref\|XM_003598.2\| Homo sapiens S100 calcium-binding protein P (S100P), mRNA | 662 | 440 | 0 | 345/349 |
| 185 | 197 | NM_005980 | gi\|5174662\|ref\|NM_005980.1\| Homo sapiens S100 calcium-binding protein P (S100P), mRNA | 565 | 439 | 1E−159 | 291/293 |
| 190 | 199 | M80340 | gi\|339767\|gb\|M80340.1\|HUMTNL12 Human transposon L1.1 with a base deletion relative to L1.2B resulting in a premature stop codon in the coding region | 539 | 6075 | 1E−151 | 351/377 |
| 191 | 199 | U93574 | gi\|2072975\|gb\|U93574.1\|HSU93574 Human L1 element L1.39 p40 and putative p150 genes, complete cds | 404 | 5979 | 1E−111 | 290/318 |
| 192 | 200 | AC002143 | gi\|2168303\|gb\|AC002143.1\|AC002143 Homo sapiens (subclone 4_b10 from BAC H102) DNA sequence, complete sequence | 214 | 4025 | 8E−54 | 235/275 |
| 193 | 176 | BC002710 | gi\|12803744\|gb\|BC002710.1\|BC002710 Homo sapiens, kallikrein 10, clone MGC: 3667, mRNA, complete cds | 648 | 1542 | 0 | 327/327 |
| 194 | 201 | XM_004286 | gi\|11418526\|ref\|XM_004286.1\| Homo sapiens ribosomal protein L10a (RPL10A), mRNA | 561 | 700 | 1E−158 | 289/291 |
| 196 | 118 | AF226998 | gi\|12655885\|gb\|AF226998.1\|AF226998 Homo sapiens dpy-30-like protein mRNA, complete cds | 505 | 734 | 1E−141 | 255/255 |
| 198 | 204 | AL3900221 | gi\|10862787\|emb\|AL390022.11\|AL390022 Human DNA sequence from clone RP11-370B6 on chromosome X, complete sequence [Homo sapiens] | 470 | 9277 | 1E−130 | 337/369 |
| 200 | 206 | BC002476 | gi\|12803316\|gb\|BC002476.1\|BC002476 Homo sapiens, non-metastatic cells 2, protein (NM23B) expressed in, clone MGC: 2212, mRNA, complete cds | 615 | 695 | 1E−174 | 316/318 |
| 201 | 207 | XM_005235 | gi\|12734360\|ref\|XM_005235.2\| Homo sapiens eukaryotic translation initiation factor 3, subunit 6 (48 kD) (EIF3S6), mRNA | 605 | 1507 | 1E−171 | 311/313 |
| 202 | 152 | BC004427 | gi\|13325215\|gb\|BC004427.1\|BC004427 Homo sapiens, proteasome (prosome, macropain) subunit, alpha type, 7, clone MGC: 3755, mRNA, complete cds | 611 | 967 | 1E−173 | 321/324 |
| 204 | 151 | AK024303 | gi\|10436651\|dbj\|AK024303.1\|AK024303 Homo sapiens cDNA FLJ14241 fis, clone OVARC1000533 | 585 | 1591 | 1E−165 | 295/295 |

TABLE 3-continued

| SEQ ID NO | CID | GenBank Accession No. | HitDesc | Score | Length | Expect | Identities |
|---|---|---|---|---|---|---|---|
| 205 | 151 | AK024303 | gi\|10436651\|dbj\|AK024303.1\|AK024303 Homo sapiens cDNA FLJ14241 fis, clone OVARC1000533 | 591 | 1591 | 1E−167 | 298/298 |
| 206 | 153 | XM_003927 | gi\|11417090\|ref\|XM_003927.1\| Homo sapiens Apg12 (autophagy 12, S. cerevisiae)-like (APG12L), mRNA | 656 | 473 | 0 | 337/339 |
| 207 | 154 | BC000947 | gi\|13111828\|gb\|BC000947.2\|BC000947 Homo sapiens, clone IMAGE: 3450586, mRNA, partial cds | 644 | 1608 | 0 | 336/340 |
| 208 | 155 | XM_004478 | gi\|12732587\|ref\|XM_004478.2\| Homo sapiens glyoxalase I (GLO1), mRNA | 660 | 1993 | 0 | 339/341 |
| 209 | 156 | L36587 | gi\|598241\|gb\|L36587.1\|HUMUHGA Homo sapiens spliced UHG RNA | 664 | 1357 | 0 | 335/335 |
| 210 | 157 | BC000447 | gi\|12653354\|gb\|BC000447.1\|BC000447 Homo sapiens, macrophage migration inhibitory factor (glycosylation-inhibiting factor), clone MGC: 8444, mRNA, complete cds | 656 | 585 | 0 | 334/335 |
| 211 | 158 | BC001708 | gi\|12804576\|gb\|BC001708.1\|BC001708 Homo sapiens, ribosomal protein S3A, clone MGC: 1626, mRNA, complete cds | 626 | 906 | 1E−178 | 319/320 |
| 212 | 159 | BC005008 | gi\|13477106\|gb\|BC005008.1\|BC005008 Homo sapiens, carcinoembryonic antigen-related cell adhesion molecule 6 (non-specific cross reacting antigen), clone MGC: 10467, mRNA, complete cds | 668 | 2249 | 0 | 337/337 |
| 213 | 160 | AL110141 | gi\|5817036\|emb\|AL110141.1\|HSM800785 Homo sapiens mRNA; cDNA DKFZp564D0164 (from clone DKFZp564D0164) | 519 | 656 | 1E−145 | 265/266 |
| 214 | 161 | NM_014366 | gi\|7657047\|ref\|NM_014366.1\| Homo sapiens putative nucleotide binding protein, estradiol-induced (E2IG3), mRNA | 634 | 2059 | 1E−180 | 335/343 |
| 215 | 162 | AL359585 | gi\|8655645\|emb\|AL359585.1\|HSM802687 Homo sapiens mRNA; cDNA DKFZp762B195 (from clone DKFZp762B195) | 129 | 2183 | 4E−28 | 68/69 |
| 217 | 195 | NM_024051 | gi\|13129017\|ref\|NM_024051.1\| Homo sapiens hypothetical protein MGC3077 (MGC3077), mRNA | 646 | 1195 | 0 | 329/330 |
| 218 | 164 | XM_006551 | gi\|11441541\|ref\|XM_006551.1\| Homo sapiens interferon induced transmembrane protein 2 (1-8D) (IFITM2), mRNA | 601 | 905 | 1E−170 | 321/327 |
| 220 | 65 | XM_007736 | gi\|11433251\|ref\|XM_007736.1\| Homo sapiens KIAA0101 gene product (KIAA0101), mRNA | 648 | 836 | 0 | 330/331 |
| 222 | 124 | U07571 | gi\|497170\|gb\|U07571.1\|HSU07571 Human clone S1X13-SS13A dinucleotide repeat at Xq21 | 46.1 | 392 | 0.005 | 23/23 |
| 223 | 126 | AF288394 | gi\|12620197\|gb\|AF288394.1\|AF288394 Homo sapiens C1orf19 mRNA, partial cds | 718 | 1961 | 0 | 377/382 |
| 224 | 132 | U35622 | gi\|5733846\|gb\|U35622.2\|HSU35622 Homo sapiens EWS protein/E1A enhancer binding protein chimera mRNA, complete cds | 779 | 2107 | 0 | 398/400 |
| 225 | 291 | BC004928 | gi\|13436256\|gb\|BC004928.1\|BC004928 Homo sapiens, clone MGC: 10493, mRNA, complete cds | 793 | 2567 | 0 | 400/400 |
| 226 | 142 | AL137736 | gi\|6808315\|emb\|AL137736.1\|HSM802318 Homo sapiens mRNA; cDNA DKFZp586P2321 (from clone DKFZp586P2321) | 692 | 2053 | 0 | 363/365 |
| 227 | 144 | XM_008130 | gi\|11424226\|ref\|XM_008130.1\| Homo sapiens galactokinase 1 (GALK1), mRNA | 785 | 1361 | 0 | 396/396 |
| 228 | 115 | AF019770 | gi\|2674084\|gb\|AF019770.1\|AF019770 Homo sapiens macrophage inhibitory cytokine-1 (MIC-1) mRNA, complete cds | 1370 | 1202 | 0 | 721/729 |

TABLE 3-continued

| SEQ ID NO | CID | GenBank Accession No. | HitDesc | Score | Length | Expect | Identities |
|---|---|---|---|---|---|---|---|
| 230 | 255 | AF179710 | gi\|9836821\|gb\|AF179710.1\|AF179710 *Pongo pygmaeus* RH50 glycoprotein (RHAG) gene, intron 9 | 40.1 | 1096 | 0.35 | 20/20 |
| 231 | 262 | XM_009943 | gi\|11418022\|ref\|XM_009943.1\| *Homo sapiens* tissue inhibitor of metalloproteinase 3 (Sorsby fundus dystrophy, pseudoinflammatory) (TIMP3), mRNA | 864 | 5486 | 0 | 455/462 |
| 232 | 256 | AF134904 | gi\|4809150\|gb\|AF134904.1\|AF134904 *Schistocerca gregaria* semaphorin 2a mRNA, complete cds | 42.1 | 2558 | 0.097 | 21/21 |
| 233 | 263 | BC003002 | gi\|12804286\|gb\|BC003002.1\|BC003002 *Homo sapiens*, polo (*Drosophia*)-like kinase, clone MGC: 3988, mRNA, complete cds | 523 | 2165 | 1E-147 | 284/294 |
| 234 | 265 | M68513 | gi\|199119\|gb\|M68513.1\|MUSMEK4 Mouse eph-related receptor tyrosine kinase (Mek4) mRNA, complete cds | 882 | 3197 | 0 | 491/503 |
| 235 | 264 | XM_007931 | gi\|12739533\|ref\|XM_007931.2\| *Homo sapiens* solute carrier family 9 (sodium/hydrogen exchanger), isoform 3 regulatory factor 2 (SLC9A3R2), mRNA | 730 | 1593 | 0 | 407/414 |
| 236 | 266 | XM_003748 | gi\|12731108\|ref\|XM_003748.2\| *Homo sapiens* serum-inducible kinase (SNK), mRNA | 387 | 2967 | 1E-106 | 267/302 |
| 239 | 269 | BC001401 | gi\|12655098\|gb\|BC001401.1\|BC001401 *Homo sapiens*, Similar to sterile-alpha motif and leucine zipper containing kinase AZK, clone MGC: 808, mRNA, complete cds | 773 | 1571 | 0 | 396/398 |
| 240 | 270 | S76617 | gi\|914203\|gb\|S76617.1\|S76617 blk = protein tyrosine kinase [human, B lymphocytes, mRNA, 2608 nt] | 38.2 | 2608 | 0.87 | 19/19 |
| 242 | 273 | AK006144 | gi\|12839086\|dbj\|AK006144.1\|AK006144 *Mus musculus* adult male testis cDNA, RIKEN full-length enriched library, clone: 1700020B19, full insert sequence | 323 | 1387 | 1E-86 | 233/255 |
| 243 | 276 | X91656 | gi\|2125862\|emb\|X91656.1\|MMSRP20 *M. musculus* Srp20 gene | 494 | 13121 | 1E-138 | 262/265 |
| 247 | 236 | BC002499 | gi\|12803360\|gb\|BC002499.1\|BC002499 *Homo sapiens*, serine/threonine kinase 15, clone MGC: 1605, mRNA, complete cds | 640 | 2129 | 0 | 330/331 |
| 248 | 277 | NM_003618 | gi\|4506376\|ref\|NM_003618.1\|*Homo sapiens* mitogen-activated protein kinase kinase kinase 3 (MAP4K3), mRNA | 702 | 4380 | 0 | 361/362 |
| 249 | 278 | NM_018492 | gi\|8923876\|ref\|NM_018492.1\|*Homo sapiens* PDZ-binding kinase; T-cell originated protein kinase (TOPK), mRNA | 779 | 1548 | 0 | 400/401 |
| 250 | 278 | XM_005110 | gi\|12734111\|ref\|XM_005110.2\|*Homo sapiens* PDZ-binding kinase; T-cell originated protein kinase (TOPK), mRNA | 1003 | 1537 | 0 | 506/506 |
| 252 | 274 | BC002466 | gi\|12803300\|gb\|BC002466.1\|BC002466 *Homo sapiens*, v-raf murine sarcoma 3611 viral oncogene homolog 1, clone MGC: 2356, mRNA, complete cds | 1074 | 2451 | 0 | 575/581 |
| 253 | 280 | XM_001729 | gi\|11423735\|ref\|XM_001729.1\|*Homo sapiens* v-akt murine thymoma viral oncogene homolog 3 (protein kinase B, gamma) (AKT3), mRNA | 751 | 1658 | 0 | 385/387 |
| 254 | 259 | NM_002893 | gi\|13259504\|ref\|NM_002893.2\|*Homo sapiens* retinoblastoma-binding protein 7 (RBBP7), mRNA | 1164 | 1946 | 0 | 715/746 |
| 255 | 210 | AB056798 | gi\|13365896\|dbj\|AB056798.1\|AB056798 *Macaca fascicularis* brain cDNA clone: QflA-11110, full insert sequence | 678 | 4521 | 0 | 435/461 |
| 256 | 213 | AJ302649 | gi\|11140019\|emb\|AJ302649.1\|DRE302649 *Danio rerio* mRNA for GABAA receptor betaZ2 subunit (gabaabeta2 gene) | 42.1 | 2188 | 0.058 | 21/21 |

TABLE 3-continued

| SEQ ID NO | CID | GenBank Accession No. | HitDesc | Score | Length | Expect | Identities |
|---|---|---|---|---|---|---|---|
| 257 | 212 | L27711 | gi\|808006\|gb\|L27711.1\|HUMKAP1A Human protein phosphatase (KAP1) mRNA, complete cds | 1057 | 844 | 0 | 550/553 |
| 258 | 214 | NM_004336 | gi\|4757877\|ref\|NM_004336.1\|*Homo sapiens* budding uninhibited by benzimidazoles 1 (yeast homolog) (BUB1), mRNA | 1318 | 3446 | 0 | 694/701 |
| 260 | 216 | NM_004300 | gi\|4757713\|ref\|NM_004300.1\|*Homo sapiens* acid phosphatase 1, soluble (ACP1), transcript variant a, mRNA | 985 | 2222 | 0 | 621/656 |
| 262 | 219 | AK026166 | gi\|10438929\|dbj\|AK026166.1\|AK026166 *Homo sapiens* cDNA: FLJ22513 fis, clone HRC12111, highly similar to HUMKUP Human Ku (p70/p80) subunit mRNA | 1402 | 1813 | 0 | 838/871 |
| 263 | 252 | BC004937 | gi\|13436283\|gb\|BC004937.1\|BC004937 *Homo sapiens*, clone MGC: 10779, mRNA, complete cds | 898 | 1032 | 0 | 475/480 |
| 264 | 220 | XM_006375 | gi\|12736706\|ref\|XM_006375.2\|*Homo sapiens* glutathione S-transferase pi (GSTP1), mRNA | 1316 | 737 | 0 | 693/703 |
| 265 | 218 | BC001827 | gi\|12804774\|gb\|BC001827.1\|BC001827 *Homo sapiens*, Similar to deoxythymidylate kinase (thymidylate kinase), clone MGC: 3923, mRNA, complete cds | 1259 | 1073 | 0 | 672/683 |
| 266 | 221 | BC002900 | gi\|12804094\|gb\|BC002900.1\|BC002900 *Homo sapiens*, Similar to proteasome (prosome, macropain) subunit, alpha type, 2, clone IMAGE: 3942625, mRNA, partial cds | 1217 | 867 | 0 | 699/728 |
| 267 | 226 | AF064029 | gi\|4091894\|gb\|AF064029.1\|AF064029 *Helianthus tuberosus* lectin 1 mRNA, complete cds | 60 | 779 | 0.0000002 | 30/30 |
| 268 | 212 | L27711 | gi\|808006\|gb\|L27711.1\|HUMKAP1A Human protein phosphatase (KAP1) mRNA, complete cds | 1257 | 844 | 0 | 694/705 |
| 269 | 223 | XM_011470 | gi\|12732420\|ref\|XM_011470.1\|*Homo sapiens* myristoylated alanine-rich protein kinase C substrate (MARCKS, 80K-L) (MACS), mRNA | 1029 | 2591 | 0 | 519/519 |
| 270 | 221 | BC002900 | gi\|12804094\|gb\|BC002900.1\|BC002900 *Homo sapiens*, Similar to proteasome (prosome, macropain) subunit, alpha type, 2, clone IMAGE: 3942625, mRNA, partial cds | 1330 | 867 | 0 | 724/739 |
| 271 | 206 | BC002476 | gi\|12803316\|gb\|BC002476.1\|BC002476 *Homo sapiens*, non-metastatic cells 2, protein (NM23B) expressed in, clone MGC: 2212, mRNA, complete cds | 1203 | 695 | 0 | 610/611 |
| 272 | 225 | XM_007980 | gi\|12739602\|ref\|XM_007980.2\|*Homo sapiens* membrane-associated tyrosine- and threonine-specific cdc2-inhibitory kinase (PKMYT1), mRNA | 904 | 1866 | 0 | 481/487 |
| 273 | 231 | S50810 | gi\|262070\|gb\|S50810.1\|S50810 {satellite DNA} [*Drosophila melanogaster*, Doc mobile element, Transposon, 1086 nt] | 52 | 1086 | 0.00003 | 29/30 |
| 274 | 233 | AF217396 | gi\|8132773\|gb\|AF217396.1\|AF217396 *Drosophila melanogaster* clone 2G2 unknown mRNA | 46.1 | 2007 | 0.004 | 23/23 |
| 275 | 232 | L29057 | gi\|609636\|gb\|L29057.1\|XELCADH *Xenopus laevis* (clone: XTCAD-1) cadherin gene, complete cds | 40.1 | 4097 | 0.081 | 20/20 |
| 276 | 227 | XM_008475 | gi\|11426657\|ref\|XM_008475.1\|*Homo sapiens* KIAA0100 gene product (KIAA0100), mRNA | 40.1 | 6962 | 0.32 | 20/20 |
| 277 | 229 | M34230 | gi\|204651\|gb\|M34230.1\|RATHPA1 Rat haptoglobin (Hp) gene, exons 1, 2 and 3 | 56 | 3282 | 0.000002 | 28/28 |
| 278 | 230 | AJ302649 | gi\|11140019\|emb\|AJ302649.1\|DRE302649 *Danio rerio* mRNA for GABAA receptor betaZ2 subunit (gabaabeta2 gene) | 50.1 | 2188 | 0.0002 | 25/25 |

TABLE 3-continued

| SEQ ID NO | CID | GenBank Accession No. | HitDesc | Score | Length | Expect | Identities |
|---|---|---|---|---|---|---|---|
| 279 | 239 | NM_021158 | gi|11056039|ref|NM_021158.1| Homo sapiens protein kinase domains containing protein similar to phosphoprotein C8FW (LOC57761), mRNA | 710 | 2257 | 0 | 358/358 |
| 280 | 238 | AX030958 | gi|10278361|emb|AX030958.1|AX030958 Sequence 7 from Patent WO9800549 | 56 | 3828 | 0.000005 | 28/28 |
| 281 | 228 | XM_010102 | gi|11419709|ref|XM_010102.1| Homo sapiens phosphoglycerate kinase 1 (PGK1), mRNA | 1469 | 1767 | 0 | 839/865 |
| 282 | 235 | U00238 | gi|404860|gb|U00238.1|U00238 Homo sapiens glutamine PRPP amidotransferase (GPAT) mRNA, complete cds | 1132 | 3600 | 0 | 653/677 |
| 283 | 237 | NM_002753 | gi|4506080|ref|NM_002753.1| Homo sapiens mitogen-activated protein kinase 10 (MAPK10), mRNA | 733 | 2372 | 0 | 381/385 |
| 284 | 241 | XM_006151 | gi|12736568|ref|XM_006151.2| Homo sapiens similar to serine protease, umbilical endothelium (H. sapiens) (LOC63320), mRNA | 979 | 1640 | 0 | 494/494 |
| 285 | 242 | BC004215 | gi|13278917|gb|BC004215.1|BC004215 Homo sapiens, eukaryotic translation elongation factor 1 gamma, clone MGC: 4501, mRNA, complete cds | 1106 | 3373 | 0 | 578/585 |
| 286 | 243 | NM_000455 | gi|4507270|ref|NM_000455.1| Homo sapiens serine/threonine kinase 11 (Peutz-Jeghers syndrome) (STK11), mRNA | 1243 | 2158 | 0 | 651/660 |
| 287 | 258 | XM_004842 | gi|12733228|ref|XM_004842.2| Homo sapiens SFRS protein kinase 2 (SRPK2), mRNA | 682 | 3715 | 0 | 381/387 |
| 288 | 261 | NM_020197 | gi|9910273|ref|NM_020197.1| Homo sapiens HSKM-B protein (HSKM-B), mRNA | 561 | 1694 | 1E−158 | 346/355 |
| 289 | 260 | XM_001416 | gi|12719345|ref|XM_001416.2| Homo sapiens similar to ribosomal protein S6 kinase, 90 kD, polypeptide 1 (H. sapiens) (LOC65290), mRNA | 517 | 2966 | 1E−145 | 277/284 |
| 290 | 236 | BC002499 | gi|12803360|gb|BC002499.1|BC002499 Homo sapiens, serine/threonine kinase 15, clone MGC: 1605, mRNA, complete cds | 618 | 2129 | 1E−175 | 358/366 |
| 293 | 246 | XM_004679 | gi|11419466|ref|XM_004679.1| Homo sapiens cyclin-dependent kinase 5 (CDK5), mRNA | 383 | 987 | 1E−104 | 214/224 |
| 294 | 245 | XM_005258 | gi|11426310|ref|XM_005258.1| Homo sapiens serum/glucocorticoid regulated kinase-like (SGKL), mRNA | 902 | 2391 | 0 | 463/466 |
| 295 | 248 | XM_008654 | gi|12740227|ref|XM_008654.2| Homo sapiens mitogen-activated protein kinase kinase 4 (MAP2K4), mRNA | 662 | 3576 | 0 | 369/374 |
| 296 | 129 | BC002364 | gi|12803120|gb|BC002364.1|BC002364 Homo sapiens, non-POU-domain-containing, octamer-binding, clone MGC: 8677, mRNA, complete cds | 688 | 2645 | 0 | 347/347 |
| 298 | 2 | NM_004443 | gi|4758287|ref|NM_004443.1| Homo sapiens EphB3 (EPHB3) mRNA | 533 | 3805 | 1E−150 | 297/301 |
| 299 | 254 | XM_002383 | gi|11429253|ref|XM_002383.1| Homo sapiens activin A receptor, type I (ACVR1), mRNA | 571 | 2832 | 1E−161 | 333/340 |
| 300 | 249 | BC000633 | gi|12653696|gb|BC000633.1|BC000633 Homo sapiens, TTK protein kinase, clone MGC: 865, mRNA, complete cds | 537 | 2993 | 1E−151 | 396/419 |
| 301 | 2 | NM_004443 | gi|4758287|ref|NM_004443.1| Homo sapiens EphB3 (EPHB3) mRNA | 795 | 3805 | 0 | 453/467 |
| 302 | 224 | XM_005116 | gi|12734122|ref|XM_005116.2| Homo sapiens protein tyrosine kinase 2 beta (PTK2B), mRNA | 470 | 3396 | 1E−131 | 252/259 |
| 303 | 222 | AB056389 | gi|13358639|dbj|AB056389.1|AB056389 Macaca fascicularis brain cDNA, clone: QflA-12365 | 196 | 2038 | 9E−49 | 129/141 |

TABLE 3-continued

| SEQ ID NO | CID | GenBank Accession No. | HitDesc | Score | Length | Expect | Identities |
|---|---|---|---|---|---|---|---|
| 304 | 208 | BC002921 | gi|12804134|gb|BC002921.1|BC002921 Homo sapiens, Similar to protein kinase related to S. cerevisiae STE20, effector for Cdc42Hs, clone MGC: 10333, mRNA, complete cds | 446 | 2349 | 1E−123 | 260/274 |
| 305 | 250 | XM_004079 | gi|11417431|ref|XM_004079.1| Homo sapiens serine/threonine-protein kinase PRP4 homolog (PRP4), mRNA | 525 | 1719 | 1E−147 | 275/280 |
| 306 | 251 | XM_004306 | gi|11418576|ref|XM_004306.1| Homo sapiens v-ros avian UR2 sarcoma virus oncogene homolog 1 (ROS1), mRNA | 317 | 7375 | 4E−85 | 160/160 |
| 307 | 252 | BC004937 | gi|13436283|gb|BC004937.1|BC004937 Homo sapiens, clone MGC: 10779, mRNA, complete cds | 975 | 1032 | 0 | 567/582 |
| 308 | 253 | NM_006293 | gi|5454141|ref|NM_006293.1| Homo sapiens TYRO3 protein tyrosine kinase (TYRO3), mRNA | 823 | 4364 | 0 | 457/466 |
| 309 | 257 | X71765 | gi|402221|emb|X71765.1|PFCAATPAS P. falciparum gene for Ca2+ - ATPase | 38.2 | 5477 | 1.4 | 19/19 |

Example 2

Detection of Differential Expressions Using Arrays mRNA isolated from samples of cancerous and normal colon tissue obtained from patients were analyzed to identify genes differentially expressed in cancerous and normal cells. Normal and cancerous cells collected from cryopreserved patient tissues were isolated using laser capture microdissection (LCM) techniques, which techniques are well known in the art (see, e.g., Ohyama et al. (2000) *Biotechniques* 29:530-6; Curran et al. 2000) *Mol. Pathol.* 53:64-8; Suarez-Quian et al. (1999) *Biotechniques* 26:328-35; Simone et al. (1998) *Trends Genet* 14:272-6; Conia et al. (1997) *J. Clin. Lab. Anal.* 11:28-38; Emmert-Buck et al. (1996) *Science* 274:998-1001).

Tables 4A and 4B provide information about each patient from which the samples were isolated, including: the "Patient ID" and "Path ReportID", which are numbers assigned to the patient and the pathology reports for identification purposes; the "Group" to which the patients have been assigned; the anatomical location of the tumor ("Anatom Loc"); the "Primary Tumor Size"; the "Primary Tumor Grade"; the identification of the histopathological grade ("Histopath Grade"); a description of local sites to which the tumor had invaded ("Local Invasion"); the presence of lymph node metastases ("Lymph Node Met"); the incidence of lymph node metastases (provided as a number of lymph nodes positive for metastasis over the number of lymph nodes examined) ("Incidence Lymphnode Met"); the "Regional Lymphnode Grade"; the identification or detection of metastases to sites distant to the tumor and their location ("Distant Met & Loc"); a description of the distant metastases ("Descrip Distant Met"); the grade of distant metastasis ("Dist Met Grade"); and general comments about the patient or the tumor ("Comments"). Adenoma was not described in any of the patients; adenoma dysplasia (described as hyperplasia by the pathologist) was described in Patient ID No. 695. Extranodal extensions were described in two patients, Patient ID Nos. 784 and 791. Lymphovascular invasion was described in seven patients, Patient ID Nos. 128, 278, 517, 534, 784, 786, and 791. Crohn's-like infiltrates were described in seven patients, Patient ID Nos. 52, 264, 268, 392, 393, 784, and 791.

TABLE 4A

| Patient ID | Path Report ID | Group | Anatom Loc | Primary Tumor Size | Primary Tumor Grade | Histopath Grade | Local Invasion |
|---|---|---|---|---|---|---|---|
| 15 | 21 | III | Ascending colon | 4 | T3 | G2 | extending into subserosal adipose tissue |
| 52 | 71 | II | Ascending colon | 9 | T3 | G3 | Invasion through muscularis propria, subserosal involvement; ileocec. valve involvement |
| 121 | 140 | II | Sigmoid | 6 | T4 | G2 | Invasion of muscularis propria into serosa, involving submucosa of urinary bladder |
| 125 | 144 | II | Cecum | 6 | T3 | G2 | Invasion through the muscularis propria into suserosal adipose tissue. Ileocecal junction. |

TABLE 4A-continued

| Patient ID | Path Report ID | Group | Anatom Loc | Primary Tumor Size | Primary Tumor Grade | Histopath Grade | Local Invasion |
|---|---|---|---|---|---|---|---|
| 128 | 147 | III | Transverse colon | 5 | T3 | G2 | Invasion of muscularis propria into percolonic fat |
| 130 | 149 | | Splenic flexure | 5.5 | T3 | | through wall and into surrounding adipose tissue |
| 133 | 152 | II | Rectum | 5 | T3 | G2 | Invasion through muscularis propria into non-peritonealized pericolic tissue; gross configuration is annular. |
| 141 | 160 | IV | Cecum | 5.5 | T3 | G2 | Invasion of muscularis propria into pericolonic adipose tissue, but not through serosa. Arising from tubular adenoma. |
| 156 | 175 | III | Hepatic flexure | 3.8 | T3 | G2 | Invasion through mucsularis propria into subserosa/pericolic adipose, no serosal involvement. Gross configuration annular. |
| 228 | 247 | III | Rectum | 5.8 | T3 | G2 to G3 | Invasion through muscularis propria to involve subserosal, perirectoal adipose, and serosa |
| 264 | 283 | II | Ascending colon | 5.5 | T3 | G2 | Invasion through muscularis propria into subserosal adipose tissue. |
| 266 | 285 | III | Transverse colon | 9 | T3 | G2 | Invades through muscularis propria to involve pericolonic adipose, extends to serosa. |
| 268 | 287 | I | Cecum | 6.5 | T2 | G2 | Invades full thickness of muscularis propria, but mesenteric adipose free of malignancy |
| 278 | 297 | III | Rectum | 4 | T3 | G2 | Invasion into perirectal adipose tissue. |
| 295 | 314 | II | Ascending colon | 5 | T3 | G2 | Invasion through muscularis propria into percolic adipose tissue. |
| 339 | 358 | II | Rectosigmoid | 6 | T3 | G2 | Extends into perirectal fat but does not reach serosa |
| 341 | 360 | II | Ascending colon | 2 cm invasive | T3 | G2 | Invasion through muscularis propria to involve pericolonic fat. Arising from villous adenoma. |
| 356 | 375 | II | Sigmoid | 6.5 | T3 | G2 | Through colon wall into subserosal adipose tissue. No serosal spread seen. |
| 360 | 412 | III | Ascending colon | 4.3 | T3 | G2 | Invasion thru muscularis propria to pericolonic fat |
| 392 | 444 | IV | Ascending colon | 2 | T3 | G2 | Invasion through muscularis propria into subserosal adipose tissue, not serosa. |

TABLE 4A-continued

| Patient ID | Path Report ID | Group | Anatom Loc | Primary Tumor Size | Primary Tumor Grade | Histopath Grade | Local Invasion |
|---|---|---|---|---|---|---|---|
| 393 | 445 | II | Cecum | 6 | T3 | G2 | Cecum, invades through muscularis propria to involve subserosal adipose tissue but not serosa. |
| 413 | 465 | IV | Ascending colon | 4.8 | T3 | G2 | Invasive through muscularis to involve periserosal fat; abutting ileocecal junction. |
| 505 | 383 | IV | | 7.5 cm max dim | T3 | G2 | Invasion through muscularis propria involving pericolic adipose, serosal surface uninvolved |
| 517 | 395 | IV | Sigmoid | 3 | T3 | G2 | penetrates muscularis propria, involves pericolonic fat. |
| 534 | 553 | II | Ascending colon | 12 | T3 | G3 | Invasion through the muscularis propria involving pericolic fat. Serosa free of tumor. |
| 546 | 565 | IV | Ascending colon | 5.5 | T3 | G2 | Invasion through muscularis propria extensively through submucosal and extending to serosa. |
| 577 | 596 | II | Cecum | 11.5 | T3 | G2 | Invasion through the bowel wall, into suberosal adipose. Serosal surface free of tumor. |
| 695 | 714 | II | Cecum | 14 | T3 | G2 | extending through bowel wall into serosal fat |
| 784 | 803 | IV | Ascending colon | 3.5 | T3 | G3 | through muscularis propria into pericolic soft tissues |
| 786 | 805 | IV | Descending colon | 9.5 | T3 | G2 | through muscularis propria into pericolic fat, but not at serosal surface |
| 791 | 810 | IV | Ascending colon | 5.8 | T3 | G3 | through the muscularis propria into pericolic fat |
| 888 | 908 | IV | Ascending colon | 2 | T2 | G1 | into muscularis propria |
| 889 | 909 | IV | Cecum | 4.8 | T3 | G2 | through muscularis propria int subserosal tissue |

TABLE 4B

| Patient ID | Lymphnode Met | Incidence Lymphnode Met | Regional Lympnode Grade | Distant Met & Loc | Descrip Distant Met | Dist Met Grade | Comment |
|---|---|---|---|---|---|---|---|
| 15 | positive | 8-Mar | N1 | negative | | MX | invasive adenocarcinoma, moderately differentiated; focal perineural invasion is seen |
| 52 | negative | 0/12 | N0 | negative | | M0 | Hyperplastic polyp in appendix. |
| 121 | negative | 0/34 | N0 | negative | | M0 | Perineural invasion; donut anastomosis negative. One tubulovillous and one tubular adenoma with no high grade dysplasia. |

TABLE 4B-continued

| Patient ID | Lymphnode Met | Incidence Lymphnode Met | Regional Lympnode Grade | Distant Met & Loc | Descrip Distant Met | Dist Met Grade | Comment |
|---|---|---|---|---|---|---|---|
| 125 | negative | 0/19 | N0 | negative | | M0 | patient history of metastatic melanoma |
| 128 | positive | 5-Jan | N1 | negative | | M0 | |
| 130 | positive | 24-Oct | N2 | negative | | M1 | |
| 133 | negative | 0/9 | N0 | negative | | M0 | Small separate tubular adenoma (0.4 cm) |
| 141 | positive | 21-Jul | N2 | positive (Liver) | adenocarcinoma consistant with primary | M1 | Perineural invasion identified adjacent to metastatic adenocarcinoma. |
| 156 | positive | 13-Feb | N1 | negative | | M0 | Separate tubolovillous and tubular adenomas |
| 228 | positive | 8-Jan | N1 | negative | | MX | Hyperplastic polyps |
| 264 | negative | 0/10 | N0 | negative | | M0 | Tubulovillous adenoma with high grade dysplasia |
| 266 | negative | 0/15 | N1 | positive (Mesenteric deposit) | 0.4 cm, may represent lymphnode completely replaced by tumor | MX | |
| 268 | negative | 0/12 | N0 | negative | | M0 | |
| 278 | positive | 10-Jul | N2 | negative | | M0 | Descending colon polyps, no HGD or carcinoma identified. |
| 295 | negative | 0/12 | N0 | negative | | M0 | Melanosis coli and diverticular disease. |
| 339 | negative | 0/6 | N0 | negative | | M0 | 1 hyperplastic polyp identified |
| 341 | negative | 0/4 | N0 | negative | | MX | |
| 356 | negative | 0/4 | N0 | negative | | M0 | |
| 360 | positive | 5-Jan | N1 | negative | | M0 | Two mucosal polyps |
| 392 | positive | 6-Jan | N1 | positive (Liver) | Macrovesicular and microvesicular steatosis | M1 | Tumor arising at prior ileocolic surgical anastomosis. |
| 393 | negative | 0/21 | N0 | negative | | M0 | |
| 413 | negative | 0/7 | N0 | positive (Liver) | adenocarcinoma in multiple slides | M1 | rediagnosis of oophorectomy path to metastatic colon cancer. |
| 505 | positive | 17-Feb | N1 | positive (Liver) | moderately differentiated adenocarcinoma, consistant with primary | M1 | Anatomical location of primary not notated in report. Evidence of chronic colitis. |
| 517 | positive | 6-Jun | N2 | negative | | M0 | No mention of distant met in report |
| 534 | negative | 0/8 | N0 | negative | | M0 | Omentum with fibrosis and fat necrosis. Small bowel with acute and chronic serositis, focal abscess and adhesions. |
| 546 | positive | 12-Jun | N2 | positive (Liver) | metastatic adenocarcinoma | M1 | |
| 577 | negative | 0/58 | N0 | negative | | M0 | Appendix dilated and fibrotic, but not involved by tumor |
| 695 | negative | 0/22 | N0 | negative | | MX | tubular adenoma and hyperplstic polyps present, moderately differentiated adenoma with mucinous diferentiation (% not stated) |
| 784 | positive | 17-May | N2 | positive (Liver) | | M1 | invasive poorly differentiated |

TABLE 4B-continued

| Patient ID | Lymphnode Met | Incidence Lymphnode Met | Regional Lympnode Grade | Distant Met & Loc | Descrip Distant Met | Dist Met Grade | Comment |
|---|---|---|---|---|---|---|---|
| 786 | negative | 0/12 | N0 | positive (Liver) | | M1 | adenosquamous carcinoma moderately differentiated invasive adenocarcinoma |

Identification of Differentially Expressed Genes cDNA probes were prepared from total RNA isolated from the patient cells described above. Since LCM provides for the isolation of specific cell types to provide a substantially homogenous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) *Nature Med* 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from normal cell RNA sample. For example, the cDNA probes from the normal cells were labeled with Cy3 fluorescent dye (green) and the cDNA probes prepared from the tumor cells were labeled with Cy5 fluorescent dye (red), and vice versa.

Each array used had an identical spatial layout and control spot set. Each microarray was divided into two areas, each area having an array with, on each half, twelve groupings of 32×12 spots, for a total of about 9,216 spots on each array. The two areas are spotted identically which provide for at least two duplicates of each clone per array.

Polynucleotides for use on the arrays were obtained from both publicly available sources and from cDNA libraries generated from selected cell lines and patient tissues. PCR products of from about 0.5 kb to 2.0 kb amplified from these sources were spotted onto the array using a Molecular Dynamics Gen III spotter according to the manufacturer's recommendations. The first row of each of the 24 regions on the array had about 32 control spots, including 4 negative control spots and 8 test polynucleotides. The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about four duplicate measurements for each clone, two of one color and two of the other, for each sample.

Table 5 describes the physical location of the differentially expressed polynucleotides on the arrays. Table 5 includes: 1) a Spot ID, which is a unique identifier for each spot containing target sequence of interest on all arrays used; 2) a "Chip Num" which refers to a particular array representing a specific set of genes; 3) the "Sample Name or Clone Name" from which the sequence was obtained; and 4) the coordinates of the sequence on the particular array ("Coordinates"). Table 6 provides information about the sequences on the arrays, specifically: 1) Candidate Identification Number; 2) Sample name or clone name; 3) function of the gene corresponding to the sequence (as determined by homology to genes of known function by BLAST search of GenBank); 4) the class of the gene (as determined by homology to genes of known function by BLAST search of GenBank); 5) the pathway in which the gene is implicated; 6) gene assignment; which refers to the gene to which the sequence has the greatest homology or identity; 7) the "Gene Symbol"; 8) chromosome number on which the gene is located ("Chrom Num"); 9) the map position on the chromosome.

TABLE 5

| SpotID | Chip Num | Sample Name or Clone Name | Coords |
|---|---|---|---|
| 27 | 1 | M00023371A:G03 | 1:85 |
| 195 | 1 | M00001489B:G04 | 1:227 |
| 212 | 1 | M00026888A:A03 | 1:244 |
| 335 | 1 | M00001558C:B06 | 1:367 |
| 511 | 1 | M00003852B:C01 | 2:191 |
| 538 | 1 | M00022009A:A12 | 2:218 |
| 599 | 1 | M00001374A:A06 | 2:279 |
| 943 | 1 | M00001341B:A11 | 3:271 |
| 1048 | 1 | M00007965C:G08 | 3:376 |
| 1160 | 1 | M00022140A:E11 | 4:136 |
| 1176 | 1 | M00022180D:E11 | 4:152 |
| 1195 | 1 | M00001675B:G05 | 4:171 |
| 1203 | 1 | M00003853B:G11 | 4:179 |
| 1252 | 1 | M00022742A:F08 | 4:228 |
| 1266 | 1 | M00026900D:F02 | 4:242 |
| 1605 | 1 | M00001496A:G03 | 5:229 |
| 1648 | 1 | M00001393D:F01 | 5:272 |
| 1793 | 1 | M00023283C:C06 | 6:65 |
| 1927 | 1 | M00007985A:B08 | 6:199 |
| 1933 | 1 | M00007985B:A03 | 6:205 |
| 2332 | 1 | M00026903D:D11 | 7:252 |
| 2404 | 1 | M00006883D:H12 | 7:324 |
| 2633 | 1 | M00007987D:D04 | 8:201 |
| 2659 | 1 | M00023431B:A01 | 8:227 |
| 2662 | 1 | M00023363C:A04 | 8:230 |
| 2799 | 1 | M00004031B:D12 | 8:367 |
| 2889 | 1 | M00003814C:C11 | 9:105 |
| 2917 | 1 | M00007935D:A05 | 9:133 |
| 3005 | 1 | M00021956B:A09 | 9:221 |
| 3204 | 1 | M00027066B:E09 | 10:68 |
| 3296 | 1 | M00022215C:A10 | 10:160 |
| 3313 | 1 | M00003961B:H05 | 10:177 |
| 3519 | 1 | M00005360A:A07 | 10:383 |
| 3665 | 1 | M0001600C:B11 | 11:177 |
| 3748 | 1 | M00001402B:C12 | 11:260 |
| 3974 | 1 | M00022168B:F02 | 12:134 |
| 4040 | 1 | M00008049B:A12 | 12:200 |
| 8594 | 2 | RG:742775:10011:A07 | 1:178 |

TABLE 5-continued

| SpotID | Chip Num | Sample Name or Clone Name | Coords |
|---|---|---|---|
| 8630 | 2 | I:2458926:03B01:C07 | 1:214 |
| 8788 | 2 | I:3229778:02B01:B07 | 1:372 |
| 8840 | 2 | I:1857563:05B02:D01 | 2:72 |
| 9042 | 2 | I:4072558:12B01:A07 | 2:274 |
| 9191 | 2 | I:1421929:05A01:D02 | 3:71 |
| 9349 | 2 | I:1723834:01A01:C02 | 3:229 |
| 9478 | 2 | I:1817434:02B01:C02 | 3:358 |
| 9489 | 2 | I:1750782:02A01:A08 | 3:369 |
| 9547 | 2 | I:1297179:05A02:F02 | 4:75 |
| 9684 | 2 | I:1443877:03B02:B08 | 4:212 |
| 9724 | 2 | I:1384823:01B02:F08 | 4:252 |
| 9739 | 2 | I:2902903:12A02:F02 | 4:267 |
| 9809 | 2 | I:2152363:04A02:A08 | 4:337 |
| 10000 | 2 | RG:813679:10011:H03 | 5:176 |
| 10006 | 2 | RG:759927:10011:C09 | 5:182 |
| 10153 | 2 | I:1712592:04A01:E03 | 5:329 |
| 10168 | 2 | I:2615513:04B01:D09 | 5:344 |
| 10200 | 2 | I:1702266:02B01:D09 | 5:376 |
| 10299 | 2 | I:2825369:07A02:F09 | 6:123 |
| 10394 | 2 | I:1450639:03B02:E09 | 6:218 |
| 10426 | 2 | I:2499976:01B02:E09 | 6:250 |
| 10600 | 2 | I:1749883:05B01:D04 | 7:72 |
| 10614 | 2 | I:1516301:05B01:C10 | 7:86 |
| 10621 | 2 | I:1298021:05A01:G10 | 7:93 |
| 10744 | 2 | I:1613615:03B01:D10 | 7:216 |
| 10877 | 2 | I:1395918:04A01:G10 | 7:349 |
| 10956 | 2 | I:1600586:05B02:F04 | 8:76 |
| 10984 | 2 | I:1666080:07B02:D04 | 8:104 |
| 11017 | 2 | I:1633286:06A02:E04 | 8:137 |
| 11019 | 2 | I:1609538:06A02:F04 | 8:139 |
| 11035 | 2 | I:1630804:06A02:F10 | 8:155 |
| 11223 | 2 | I:1749417:04A02:D10 | 8:343 |
| 11245 | 2 | I:1809385:02A02:G04 | 8:365 |
| 11258 | 2 | I:1854245:02B02:E10 | 8:378 |
| 11445 | 2 | I:1854558:03A01:C11 | 9:213 |
| 11569 | 2 | I:1509602:04A01:A11 | 9:337 |
| 11739 | 2 | I:1699587:06A02:F11 | 10:155 |
| 11838 | 2 | I:2840195:01B02:G11 | 10:254 |
| 11908 | 2 | I:2914719:04B02:B05 | 10:324 |
| 11923 | 2 | I:2239819:04A02:B11 | 10:339 |
| 12001 | 2 | I:2483109:05A01:A06 | 11:65 |
| 12007 | 2 | I:2499479:05A01:D06 | 11:71 |
| 12013 | 2 | I:2675481:05A01:G06 | 11:77 |
| 12104 | 2 | RG:773612:10011:D06 | 11:168 |
| 12270 | 2 | I:2914605:04B01:G06 | 11:334 |
| 12513 | 2 | I:2079906:01A02:A06 | 12:225 |
| 12519 | 2 | I:1810640:01A02:D06 | 12:231 |
| 16933 | 3 | I:1963753:18B01:E07 | 1:122 |
| 17035 | 3 | RG:166410:10006:F01 | 1:171 |
| 17059 | 3 | I:1920650:16A01:B01 | 1:195 |
| 17068 | 3 | I:1923769:16B01:F01 | 1:204 |
| 17069 | 3 | I:901317:16A01:G01 | 1:205 |
| 17075 | 3 | I:3518380:16A01:B07 | 1:211 |
| 17171 | 3 | RG:666323:10010:B07 | 1:307 |
| 17385 | 3 | RG:244132:10007:E01 | 2:169 |
| 17386 | 3 | RG:2117694:10016:E01 | 2:170 |
| 17399 | 3 | RG:241029:10007:D07 | 2:183 |
| 17459 | 3 | I:2056395:13A02:B07 | 2:243 |
| 17533 | 3 | RG:1555877:10013:G07 | 2:317 |
| 17696 | 3 | I:1923490:18B01:H08 | 3:128 |
| 17730 | 3 | RG:526536:10002:A02 | 3:162 |
| 17742 | 3 | RG:612874:10002:G02 | 3:174 |
| 17746 | 3 | RG:530002:10002:A08 | 3:178 |
| 17836 | 3 | RG:29739:10004:F02 | 3:268 |
| 17964 | 3 | I:1920522:15B02:F02 | 4:44 |
| 18089 | 3 | RG:244601:10007:E02 | 4:169 |
| 18100 | 3 | RG:2048081:10016:B08 | 4:180 |
| 18102 | 3 | RG:2097294:10016:C08 | 4:182 |
| 18240 | 3 | RG:1927470:10015:H08 | 4:320 |
| 18331 | 3 | I:1926006:15A01:F09 | 5:59 |
| 18379 | 3 | I:2359588:18A01:F03 | 5:107 |
| 18389 | 3 | I:986558:18A01:C09 | 5:117 |
| 18408 | 3 | I:970933:14B01:D03 | 5:136 |
| 18445 | 3 | RG:180296:10006:G03 | 5:173 |
| 18488 | 3 | I:1743234:16B01:D09 | 5:216 |
| 18552 | 3 | RG:25258:10004:D09 | 5:280 |
| 18580 | 3 | RG:985973:10012:B09 | 5:308 |
| 18801 | 3 | RG:203031:10007:A09 | 6:177 |
| 18804 | 3 | RG:2055807:10016:B09 | 6:180 |
| 18856 | 3 | I:605019:13B02:D03 | 6:232 |
| 18886 | 3 | RG:43296:10005:C03 | 6:262 |
| 18903 | 3 | RG:301608:10008:D09 | 6:279 |
| 18904 | 3 | RG:45623:10005:D09 | 6:280 |
| 18921 | 3 | RG:1461567:10013:E03 | 6:297 |
| 18942 | 3 | RG:1895716:10015:G09 | 6:318 |
| 18985 | 3 | I:1402615:09A02:E03 | 6:361 |
| 19067 | 3 | I:2054678:19A01:F10 | 7:91 |
| 19120 | 3 | I:956077:14B01:H04 | 7:144 |
| 19175 | 3 | I:750899:16A01:D04 | 7:199 |
| 19189 | 3 | I:620494:16A01:C10 | 7:213 |
| 19229 | 3 | I:2060725:13A01:G10 | 7:253 |
| 19264 | 3 | RG:35892:10004:H10 | 7:288 |
| 19374 | 3 | I:1758241:15B02:G04 | 8:46 |
| 19428 | 3 | I:1965257:18B02B04 | 8:100 |
| 19590 | 3 | RG:43534:10005:C04 | 8:262 |
| 19600 | 3 | RG:110764:10005:H04 | 8:272 |
| 19603 | 3 | RG:278409:10008:B10 | 8:275 |
| 19604 | 3 | RG:41097:10005:B10 | 8:276 |
| 19629 | 3 | RG:1552386:10013:G04 | 8:301 |
| 19642 | 3 | RG:1838677:10015:E10 | 8:314 |
| 19766 | 3 | I:1996180:19B01:C11 | 9:86 |
| 19816 | 3 | I:1431819:14B01:D05 | 9:136 |
| 19821 | 3 | I:1833191:14A01:G05 | 9:141 |
| 19822 | 3 | I:1227385:14B01:G05 | 9:142 |
| 19835 | 3 | I:2055926:14A01:F11 | 9:155 |
| 19950 | 3 | RG:32281:10004:G05 | 9:270 |
| 19962 | 3 | RG:27403:10004:E11 | 9:282 |
| 19971 | 3 | RG:665682:10010:B05 | 9:291 |
| 20102 | 3 | I:2759046:19B02:C05 | 10:70 |
| 20196 | 3 | RG:2012168:10016:B05 | 10:164 |
| 20280 | 3 | I:1960722:13B02:D11 | 10:248 |
| 20303 | 3 | RG:343821:10008:H05 | 10:271 |
| 20315 | 3 | RG:323425:10008:F11 | 10:283 |
| 20506 | 3 | I:1969044:18B01:E12 | 11:122 |
| 20586 | 3 | I:659143:16B01:E06 | 11:202 |
| 20691 | 3 | RG:669110:10010:B12 | 11:307 |
| 20703 | 3 | RG:740831:10010:H12 | 11:319 |
| 20775 | 3 | I:1968921:15A02:D06 | 12:39 |
| 20878 | 3 | I:998612:14B02:G06 | 12:142 |
| 20915 | 3 | RG:208954:10007:B12 | 12:179 |
| 20940 | 3 | I:1967543:16B02:F06 | 12:204 |
| 21017 | 3 | RG:306813:10008:E12 | 12:281 |
| 21025 | 3 | RG:1353123:10013:A06 | 12:289 |
| 21068 | 3 | I:549299:17B02:F:06 | 12:332 |
| 21160 | 4 | RG:1996901:20003:D01 | 1:104 |
| 21207 | 4 | M00056483D:G07 | 1:151 |
| 21294 | 4 | M00042439D:C11 | 1:238 |
| 21354 | 4 | RG:781507:10011:E01 | 1:298 |
| 21518 | 4 | RG:1374447:20004:G01 | 2:110 |
| 21544 | 4 | M00056908A:H05 | 2:136 |
| 21589 | 4 | M00054777D:E09 | 2:181 |
| 21674 | 4 | RG:2002384:20003:E01 | 2:266 |
| 21705 | 4 | RG:1651303:10014:E01 | 2:297 |
| 21732 | 4 | M00054538C:C01 | 2:324 |
| 21763 | 4 | M00056622B:F12 | 2:355 |
| 21769 | 4 | M00056632B:H10 | 2:361 |
| 21784 | 4 | M00055423A:C07 | 2:376 |
| 21812 | 4 | M00056308A:F02 | 3:52 |
| 21884 | 4 | RG:2006302:20003:F08 | 3:124 |
| 21921 | 4 | M00054639D:F05 | 3:161 |
| 21983 | 4 | M00057081B:H03 | 3:223 |
| 22023 | 4 | M00056533D:G07 | 3:263 |
| 22027 | 4 | M00056534C:E08 | 3:267 |
| 22043 | 4 | M00056585B:F04 | 3:283 |
| 22060 | 4 | RG:785846:10011:F02 | 3:300 |
| 22072 | 4 | RG:781028:10011:D08 | 3:312 |
| 22254 | 4 | M00056918C:F09 | 4:142 |
| 22285 | 4 | M00054742C:B12 | 4:173 |
| 22299 | 4 | M00054806G:G03 | 4:187 |
| 22366 | 4 | M00056350B:B03 | 4:254 |
| 22375 | 4 | M00056728C:G02 | 4:263 |
| 22405 | 4 | RG:1637619:10014:C02 | 4:293 |

TABLE 5-continued

| SpotID | Chip Num | Sample Name or Clone Name | Coords |
|---|---|---|---|
| 22415 | 4 | RG:1674393:10014:H02 | 4:303 |
| 22419 | 4 | RG:1635546:10014:B08 | 4:307 |
| 22498 | 4 | M00056250C:B02 | 5:34 |
| 22619 | 4 | M00056500C:A07 | 5:155 |
| 22633 | 4 | M00054647A:A09 | 5:169 |
| 22678 | 4 | M00057231A:G04 | 5:214 |
| 22724 | 4 | RG:1861510:20001:B03 | 5:260 |
| 22775 | 4 | RG:417109:10009:D09 | 5:311 |
| 22783 | 4 | RG:487171:10009:H09 | 5:319 |
| 23103 | 4 | M00056810A:A02 | 6:287 |
| 23179 | 4 | M00056645C:D11 | 6:363 |
| 23183 | 4 | M00056646B:F07 | 6:367 |
| 23189 | 4 | M00056679B:H03 | 6:373 |
| 23286 | 4 | RG:1996788:20003:C10 | 7:118 |
| 23337 | 4 | M00054650D:E04 | 7:169 |
| 23371 | 4 | M00057044D:G03 | 7:203 |
| 23373 | 4 | M00057046A:G09 | 7:205 |
| 23380 | 4 | M00057241C:F03 | 7:212 |
| 23394 | 4 | M00042756A:H02 | 7:226 |
| 23471 | 4 | RG:471154:10009:H04 | 7:303 |
| 23514 | 4 | M00054520A:D04 | 7:346 |
| 23803 | 4 | M00056812D:A08 | 8:283 |
| 23813 | 4 | RG:1638979:10014:C04 | 8:293 |
| 23984 | 4 | RG:2051667:20003:H05 | 9:112 |
| 24185 | 4 | RG:432960:10009:E11 | 9:313 |
| 24186 | 4 | RG:785368:10011:E11 | 9:314 |
| 24297 | 4 | M00055209C:B07 | 10:73 |
| 24358 | 4 | M00056937C:C10 | 10:134 |
| 24394 | 4 | M00056992C:F12 | 10:170 |
| 24423 | 4 | M00057126C:B03 | 10:199 |
| 24429 | 4 | M00057127B:B09 | 10:205 |
| 24515 | 4 | RG:1630930:10014:B05 | 10:291 |
| 24519 | 4 | RG:1645945:10014:D05 | 10:295 |
| 24700 | 4 | RG:2006592:20003:F12 | 11:124 |
| 24713 | 4 | M00056478D:B07 | 11:137 |
| 24728 | 4 | M00056227B:G06 | 11:152 |
| 24806 | 4 | M00042770D:G04 | 11:230 |
| 24855 | 4 | M00056619A:H02 | 11:279 |
| 24866 | 4 | RG:742764:10011:A06 | 11:290 |
| 24867 | 4 | RG:364972:10009:B06 | 11:291 |
| 24883 | 4 | RG:376554:10009:B12 | 11:307 |
| 24900 | 4 | M00054500D:C08 | 11:324 |
| 24944 | 4 | M00054971D:D07 | 11:368 |
| 25021 | 4 | M00055258B:D12 | 12:93 |
| 25095 | 4 | M00054769A:E05 | 12:167 |
| 25161 | 4 | M00055435B:A12 | 12:233 |
| 25203 | 4 | M00056822A:E08 | 12:275 |
| 25212 | 4 | RG:2006592:20003:F12 | 12:284 |
| 25219 | 4 | RG:1631867:10014:B06 | 12:291 |
| 25305 | 4 | M00056707D:D05 | 12:377 |
| 25309 | 4 | M00056709D:D03 | 12:381 |
| 25332 | 4 | M00055583C:B07 | 1:55 |
| 25337 | 4 | M00056301D:A04 | 1:60 |
| 25393 | 2 | I:2606813:04A02:B12 | 12:339 |
| 25430 | 2 | I:1931371:02B02:D12 | 12:376 |

TABLE 6

| CID | Sample Name or Clone Name | Function | Class | Pathway | GeneAssignment | Gene Symbol | Chromosome Num | Map Position |
|---|---|---|---|---|---|---|---|---|
| 1 | I:1222317:15A02:C02 | Unknown | Ca++ binding | | Homo sapiens S100 calcium-binding protein A4 (calcium protein, calvasculin, metastasin, murine placental homolog) (S100A4) mRNA > :: gb|M80563|HUMCAPL Human CAPL protein mRNA, complete cds. | S100A | 1 | 1q12-q22 |
| 2 | I:1227385:14B01:G05 | Signal Transduction | kinase | | EphB3 [Homo sapiens] | EPHB3 | 3 | 3q21 |
| 2 | RG:32281:10004:G05 | Signal Transduction | kinase | | EphB3 [Homo sapiens] | EPHB3 | 3 | 3q21 |
| 2 | RG:41097:10005:B10 | Signal Transduction | kinase | | EphB3 [Homo sapiens] | EPHB3 | 3 | 3q21 |
| 3 | I:1297179:05A02:F02 | Metabolism | dehydrogenase | folate pathway | methylenetetrahydrofolate dehydrogenase (NADP+ dependent), methenyltetrahydrofolate cyclohydrolase, formyltetrahydrofolate synthetase | MTHFD1 | 14 | 14q24 |
| 4 | I:1298021:05A01:G10 | Cell Cycle | pseudouridine (psi) synthase | rRNA processing | dyskeratosis congenital, dyskerin | DKC1 | X | Xq28 |
| 5 | I:1358285:04A02:F11 | Signal Transduction | kinase | | AXL receptor tyrosine kinase | AXL | 19 | 19q13.1 |
| 5 | M00022180D:E11 | Signal Transduction | kinase | | AXL receptor tyrosine kinase | AXL | 19 | 19q13.1 |
| 6 | I:1384823:01B02:F08 | Cell Cycle | CDC28 subunit | | CDC28 protein kinase 2 | CKS2 | 9 | 9q22 |
| 7 | I:1395918:04A01:G10 | Cytoskeleton | GTPase | | Arg/Abl-interacting protein ArgBP2 | ARGBP2 | 4 | 4 |
| 8 | I:1402615:09A02:E03 | Cell Cycle | ubiquitination | | Fn14 for type I transmenmbrane protein | LOC51330 | 16 | 16 |

TABLE 6-continued

| CID | Sample Name or Clone Name | Function | Class | Pathway | GeneAssignment | Gene Symbol | Chromosome Num | Map Position |
|---|---|---|---|---|---|---|---|---|
| 9 | I:1421929:05A01:D02 | Adhesion | cadherin | | cadherin 3, P-cadherin (placental) | CDH3 | 16 | 16q22 |
| 10 | I:1431819:14B01:D05 | | GTPase | | nucleolar phosphoprotein p130 | P130 | 10 | |
| 11 | I:1443877:03B02:B08 | Protein Degradation | proteasome subunit | | 26S proteasome-associated pad1 homolog | POH1 | 2 | 2 |
| 12 | I:1450639:03B02:E09 | | microtubule-organizing | | caltractin (20 kD calcium-binding protein) | CALT | X | Xq28 |
| 13 | I:1480159:06B02:E03 | Unknown | protease | | kallikrein 6 (neurosin, zyme) | KLK6 | 19 | 19q13.3 |
| 14 | I:1509602:04A01:A11 | Metabolism | lipoxygenase | arachdonic metabolism | arachidonate 5-lipoxygenase | ALOX5 | 10 | 10q11.2 |
| 15 | I:1516301:05B01:C10 | Transcription | transcription factor | | forkhead box M1 | FOXM1 | 12 | 12p13 |
| 16 | I:1600586:05B02:F04 | RNA splicing | spliceosome | | splicing factor 3b, subunit 3, 130 kD | SF3B3 | | |
| 17 | I:1609538:06A02:F04 | Mitochondrial | translocase | | translocase of outer mitochondrial membrane 34 | TOM34 | 20 | 20 |
| 18 | I:1613615:03B01:D10 | Signal Transduction | secreted | | bone morphogenetic protein 4 | BMP4 | 14 | 14q22-q23 |
| 19 | I:1630804:06A02:F10 | Metabolism | iron homeostasis | | Friedreich ataxia | FRDA | 9 | 9q13-q21.1 |
| 20 | I:1633286:06A02:E04 | Unknown | membrane | | transmembrane 4 superfamily member 4 | TM4SF4 | 3 | 3 |
| 21 | I:1666080:07B02:D04 | Unknown | novel | | | | | |
| 22 | I:1699587:06A02:F11 | Unknown | protease | | matrix metalloproteinase 7 (matrilysin, uterine) | MMP7 | 11 | 11q21-q22 |
| 23 | I:1702266:02B01:D09 | Metabolism | carboxylate reductase | amino acid synthesis | pyrroline-5-carboxylate reductase 1 | PYCR1 | 17 | 17 |
| 24 | I:1712592:04A01:E03 | | | | insulin induced gene 1 | INSIG1 | 7 | 7q36 |
| 25 | I:1723834:01A01:C02 | cell cycle | transcription factor | | minichromosome maintenance deficient (*S. cerevisiae*) 2 (mitotin) | MCM2 | 3 | 3q21 |
| 26 | I:1743234:16B01:D09 | Novel | secreted | | | | | |
| 27 | I:1749417:04A02:D10 | Unknown | protease | | cathepsin H | CTSH | 15 | 15q24-q25 |
| 28 | I:1749883:05B01:D04 | Metabolism | kinase | | pyridoxal (pyridoxine, vitamin B6) kinase | PDXK | 21 | 21q22.3 |
| 29 | I:1750782:02A01:A08 | Unknown | novel | | KIAA0007 protein | KIAA0007 | 2 | 2 |
| 30 | I:1758241:15B02:G04 | Cell Cycle | CDC28 kinase | | CDC28 protein kinase 1 | CKS1 | 8 | 8q21 |
| 30 | M00056227B:G06 | Cell Cycle | CDC28 kinase | | CDC28 protein kinase 1 | CKS1 | 8 | 8q21 |
| 31 | I:1809385:02A02:G04 | | | integrin-binding pathway | integrin beta 3 binding protein (beta3-endonexin) [*Homo sapiens*] | ITGB3BP | 1 | 1 |
| 32 | I:1810640:01A02:D06 | Adhesion | kinase | | EphA1 | EPHA1 | 7 | 7q32-q36 |
| 33 | I:1817434:02B01:C02 | Nucleotide Biosynthesis | transketolase | | transketolase (Wernicke-Korsakoff syndrome) | TKT | 3 | 3p14.3 |
| 34 | I:1833191:14A01:G05 | Unknown | | | dedicator of cytokinesis 3 | DOCK3 | 3 | 3 |
| 35 | I:1854245:02B02:E10 | Unknown | kinase | | KIAA0173 gene product [*Homo sapiens*] | KIAA0173 | 2 | 2 |
| 36 | I:1854558:03A01:C11 | Metabolism | glycosylation | | fucosyltransferase 1 (galactoside 2-alpha-L-fucosyltransferase, Bombay phenotype included) | FUT1 | 19 | 19q13.3 |
| 37 | I:1857563:05B02:D01 | | transcription factor | | 6-pyruvoyl-tetrahydropterin synthase/dimerization cofactor of hepatocyte nuclear factor 1 alpha (TCF1) | PCBD | 10 | 10q22 |
| 38 | I:1920522:15B02:F02 | Cell Cycle | | | D123 gene product | D123 | | |

TABLE 6-continued

| CID | Sample Name or Clone Name | Function | Class | Pathway | GeneAssignment | Gene Symbol | Chromosome Num | Map Position |
|---|---|---|---|---|---|---|---|---|
| 39 | I:1920650:16A01:B01 | | Ca++ signal | | annexin A3 | ANXA3 | 4 | 4q13-q22 |
| 41 | I:1923490:18B01:H08 | Unknown | phosphatase | | hypothetical protein | LOC51235 | 1 | 1 |
| 41 | M00022742A:F08 | Unknown | phosphatase | | hypothetical protein | LOC51235 | 1 | 1 |
| 42 | I:1923769:16B01:F01 | Unknown | unknown | | hypothetical protein, clone 2746033 | HSA272196 | 17 | 17q11.2 |
| 43 | I:1926006:15A01:F09 | DNA Repair | mismatch repair | | mutS (*E. coli*) homolog 6 | MSH6 | 2 | 2p16 |
| 44 | I:1931371:02B02:D12 | Unknown | microtubule-organizing | | KIAA0097 gene product | KIAA0097 | 11 | 11 |
| 45 | I:1960722:13B02:D11 | Chaperone | HSP90 | | tumor necrosis factor type 1 receptor associated protein [*Homo sapiens*] | LOC51721 | 16 | 16 |
| 46 | I:1963753:18B01:E07 | Trafficking | membrane transporter | | | | | |
| 47 | I:1965257:18B02:B04 | Unknown | novel | | | | | |
| 48 | I:1967543:16B02:F06 | Novel | secreted | | | | 13 | 13 |
| 49 | I:1968921:15A02:D06 | Adhesion | cell surface | | immunoglobulin superfamily containing leucine-rich repea | ISLR | 15 | 15q23-q24 |
| 50 | I:1969044:18B01:E12 | Unknown | kinase | | | | | |
| 51 | I:1981218:16B02:H01 | Unknown | transmembrane | | integral type I protein | P24B | 15 | 15q24-q25 |
| 53 | I:1996180:19B01:C11 | Signal Transduction | GTP effector | | | | | |
| 54 | I:2054678:19A01:F10 | Unknown | Ca++ binding | | | | 1 | 1 |
| 55 | I:2055926:14A01:F11 | Unknown | kinase | | thymidine kinase 1, soluble | TK1 | 17 | 17q23.2-q25.3 |
| 56 | I:2056395:13A02:B07 | Adhesion | fasciclin | | transforming growth factor, beta-induced, 68 kD | TGFBI | 5 | 5q31 |
| 58 | I:2060725:13A01:G10 | | Ca++ signal | | calcyclin binding protein [*Homo sapiens*] | CACYBP | 1 | 1q24-q25 |
| 59 | I:2079906:01A02:A06 | DNA Replication | replication factor | | | | | |
| 60 | I:2152363:04A02:A08 | Unknown | kinase | | non-metastatic cells 1, protein (NM23A) expressed in | NME1 | 17 | 17q21.3 |
| 63 | I:2239819:04A02:B11 | Unknown | protease | | dipeptidase 1 (renal) | DPEP1 | 16 | 16q24.3 |
| 64 | I:2359588:18A01:F03 | Unknown | unknown | | | | | |
| 65 | I:2458926:03B01:C07 | Unknown | novel | | KIAA0101 gene product [*Homo sapiens*] | KIAA0101 | 15 | 15 |
| 65 | M00055423A:C07 | Unknown | novel | | KIAA0101 gene product [*Homo sapiens*] | KIAA0101 | 15 | 15 |
| 66 | I:2483109:05A01:A06 | Unknown | kinase | | chromosome 1 open reading frame 2 | C1ORF2 | 1 | 1q21 |
| 67 | I:2499479:05A01:D06 | Transcription | | | transcription factor NRF | NRF | | |
| 68 | I:2499976:01B02:E09 | | transmembrane | | | | | |
| 70 | I:2606813:04A02:B12 | Chaperone | isomerase | | peptidylprolyl isomerase E (cyclophilin E) | PPIE | 1 | 1p32 |
| 71 | I:2615513:04B01:D09 | | antizyme inhibitor | polyamine synthesis | antizyme inhibitor [*Homo sapiens*] | LOC51582 | | |
| 74 | I:2675481:05A01:G06 | Mitochondrial | protease | | ClpP (caseinolytic protease, ATP-dependent, proteolytic subunit, *E. coli*) homolog | CLPP | 19 | 19 |
| 75 | I:2759046:19B02:C05 | Unknown | membrane | | tetraspan 5 | TSPAN-5 | 4 | 4 |
| 76 | I:2825369:07A02:F09 | Metabolism | transferase | serine biosynthesis | phosphoserine aminotransferase | PSA | 9 | 9 |
| 77 | I:2840195:01B02:G11 | Nucleotide Biosynthesis | kinase | | adenosine kinase | ADK | 10 | 10cen-q24 |
| 78 | I:2902903:12A02:F02 | Adhesion | transmembrane | | interferon induced transmembrane protein 1 (9-27) | IFITM1 | 11 | 11 |
| 79 | I:2914605:04B01:G06 | Unknown | unknown | | KIAA0170 gene product [*Homo sapiens*] | KIAA0170 | 6 | 6p21.3 |

TABLE 6-continued

| CID | Sample Name or Clone Name | Function | Class | Pathway | GeneAssignment | Gene Symbol | Chromosome Num | Map Position |
|---|---|---|---|---|---|---|---|---|
| 80 | I:2914719:04B02:B05 | | nuclear export | | RAE1 (RNA export 1, S. pombe) homolog | RAE1 | 20 | 20 |
| 81 | I:3229778:02B01:B07 | Adhesion | integrin | | integrin, alpha 2 (CD49B, alpha 2 subunit of VLA-2 receptor) | ITGA2 | 5 | 5q23-31 |
| 83 | I:3518380:16A01:B07 | Metabolism | sterol reductase | cholesterol biosynthesis | 7-dehydrocholesterol reductase | DHCR7 | 11 | 11q13.2-q13.5 |
| 85 | I:4072558:12B01:A07 | Translation | initiation factor | | | | | |
| 87 | I:549299:17B02:F06 | Novel | | | KIAA0784 protein | KIAA0784 | 20 | 20q13.13-q13.2 |
| 88 | I:605019:13B02:D03 | Unknown | transferase | | catechol-O-methyltransferase | COMT | 22 | 22q11.21 |
| 89 | I:620494:16A01:C10 | Unknown | proteasome subunit | | proteasome (prosome, macropain) subunit, beta type, 7 | PSMB7 | 9 | 9q34.11-q34.12 |
| 90 | I:659143:16B01:E06 | Unknown | novel | | | | | |
| 91 | I:750899:16A01:D04 | Unknown | phosphatase | | protein tyrosine phosphatase, receptor type, N | PTPRN | 2 | 2q35-q36.1 |
| 92 | I:763607:16A01:E09 | Unknown | unknown | | tumor protein D52-like 1 | TPD52L1 | 6 | 6q22-q23 |
| 93 | I:901317:16A01:G01 | Unknown | proteasome subunit | | proteasome (prosome, macropain) subunit, beta type, 4 | PSMB4 | 1 | 1q21 |
| 94 | I:956077:14B01:H04 | DNA Repair | GTPase | | nudix (nucleoside diphosphate linked moiety X)-type motif 1 | NUDT1 | 7 | 7p22 |
| 95 | I:970933:14B01:D03 | Novel | secreted | | FOXJ2 forkhead factor | LOC55810 | | |
| 96 | I:986558:18A01:C09 | Unknown | unknown | | | | 3 | |
| 98 | I:998612:14B02:G06 | Metabolism | dehydrogenase | | 3-phosphoglycerate dehydrogenase | PHGDH | 1 | 1p11.1-13.1 |
| 100 | M00001341B:A11 | Cell Cycle | kinase | | KIAA0175 gene product [Homo sapiens] | KIAA0175 | 9 | 9 |
| 101 | M00001349A:C11 | Adhesion | kinase | | discoidin domain receptor family, member 1 | DDR1 | 6 | 6p21.3 |
| 102 | M00001351C:E02 | Unknown | unknown | | cathepsin C | CTSC | 11 | 11q14.1-q14.3 |
| 103 | M00001374A:A06 | Unknown | desaturase | | stearoyl-CoA desaturase | SCD | 10 | 10 |
| 104 | M00001393D:F01 | Metabolism | dehydrogenase | | lactate dehydrogenase B | LDHB | 12 | 12p12.2-p12.1 |
| 105 | M00001402B:C12 | Cell Cycle | kinase | | cyclin-dependent kinase 4 | CDK4 | 12 | 12q14 |
| 106 | M00001402C:B01 | Unknown | unknown | | catenin (cadherin-associated protein), alpha-like 1 | CTNNAL1 | 9 | 9q31.2 |
| 109 | M00001489B:G04 | | | | HSPC003 protein [Homo sapiens] | HSPC003 | | |
| 110 | M00001496A:G03 | Transcription | transcription factor | | v-myb avian myeloblastosis viral oncogene homolog-like 2 | MYBL2 | 20 | 20q13.1 |
| 111 | M00001558C:B06 | Unknown | novel | | hypothetical protein | HSPC130 | 20 | 20 |
| 112 | M00001600C:B11 | | helicase | | DEAD-box protein abstrakt [Homo sapiens] | ABS | 5 | 5 |
| 113 | M00001675B:G05 | Novel | GTPase | | KIAA0712 gene product [Homo sapiens] | KIAA0712 | 11 | 11 |
| 114 | M00003814C:C11 | Unknown | novel | | KIAA0116 protein | KIAA0116 | 3 | 3 |
| 115 | M00003852B:C01 | Signal Transduction | cytokine | | prostate differentiation factor | PLAB | 19 | 19p13.1-13.2 |
| 116 | M00003853B:G11 | Unknown | novel | | | | 20 | 20 |
| 117 | M00003961B:H05 | Unknown | kinase | | EphB4 | EPHB4 | 7 | 7 |
| 118 | M00004031B:D12 | Unknown | secreted | | | | | |
| 118 | M00057112B:E11 | Unknown | secreted | | | | | |
| 120 | M00004229C:B06 | Unknown | protease | | cathepsin Z | CTSZ | 20 | 20q13 |
| 121 | M00005360A:A07 | Novel | calcitonin receptor | | EGF-like-domain, multiple 2 | EGFL2 | 1 | 1 |
| 122 | M00005438D:D06 | Unknown | protease | | beta-site APP-cleaving enzyme 2 | BACE2 | 21 | 21q22.3 |
| 123 | M00006883D:H12 | Unknown | novel | | | | | |
| 124 | M00007935D:A05 | Unknown | novel | | | | 7 | 7 |
| 125 | M00007965C:G08 | Unknown | unknown | | | | | |

TABLE 6-continued

| CID | Sample Name or Clone Name | Function | Class | Pathway | GeneAssignment | Gene Symbol | Chromosome Num | Map Position |
|---|---|---|---|---|---|---|---|---|
| 126 | M00007985A:B08 | Unknown | novel | | | | 1 | 1 |
| 127 | M00007985B:A03 | | sigma receptor | | sigma receptor (SR31747 binding protein 1) | SR-BP1 | 9 | 9 |
| 128 | M00007987D:D04 | Novel | secreted | | KIAA0179 | KIAA0179 | 21 | 21q22.3 |
| 129 | M00008049B:A12 | RNA Splicing | | | non-Pou domain-containing octamer (ATGCAAAT) binding protein [Homo sapiens] | NONO | X | Xq13.1 |
| 129 | RG:25258:10004:D09 | RNA Splicing | | | non-Pou domain-containing octamer (ATGCAAAT) binding protein [Homo sapiens] | NONO | X | Xq13.1 |
| 130 | M00008099D:A05 | Unknown | secreted | | | | 20 | 20 |
| 131 | M00021828C:F04 | Unknown | kinase | | dual-specificity tyrosine-(Y)-phosphorylation regulated kinase 4 | DYRK4 | 12 | 12 |
| 132 | M00021956B:A09 | Transcription | transcription factor | | ets variant gene 4 (E1A enhancer-binding protein, E1AF) | ETV4 | 17 | 17q21 |
| 133 | M00022009A:A12 | Unknown | unknown | | pleckstrin homology-like domain, family A, member 1 | PHLDA1 | 12 | 12q15 |
| 134 | M00022081D:G02 | Unknown | kinase | | Ste20-related serine/threonine kinase [Homo sapiens] | KIAA0204 | 10 | 10 |
| 135 | M00022158D:C11 | Adhesion | laminin | | laminin, beta 3 (nicein (125 kD), kalinin (140 kD), BM600 (125 kD)) | LAMB3 | 1 | 1q32 |
| 136 | M00022168B:F02 | Unknown | deaminase | | hypothetical protein FLJ10540 | FLJ10540 | | |
| 137 | M00022215C:A10 | Unknown | unknown | | | | | |
| 138 | M00023283C:C06 | Unknown | novel | | hypothetical protein similar to mouse HN1 (Hematological and Neurological expressed sequence 1) | HN1L | 16 | 16 |
| 139 | M00023363C:A04 | Unknown | protease | | kallikrein 11 | KLK11 | 19 | 19q13.3-q13.4 |
| 140 | M00023371A:G03 | Cell Cycle | | | retinoblastoma-binding protein 8 | RBBP8 | 18 | 18q11.2 |
| 141 | M00023431B:A01 | Ribosomal Biogenesis | small nucleolar RNA | | | | 6 | 6q14.3-16.2 |
| 142 | M00026888A:A03 | Unknown | novel | | | | | |
| 143 | M00026900D:F02 | Metabolism | transferase | | sulfotransferase family 2B, member 1 | SULT2B1 | 19 | 19q13.3 |
| 144 | M00026903D:D11 | Metabolism | kinase | | galactokinase 1 | GALK1 | 17 | 17q24 |
| 145 | M00027066B:E09 | Unknown | unknown | | | | | |
| 146 | M00032537B:F11 | Unknown | transmembrane | | | | | |
| 147 | M00042439D:C11 | Cell Cycle | ubiquitin carrier | | ubiquitin carrier protein E2-C | UBCH10 | 20 | 20 |
| 148 | M00042704D:D09 | Unknown | novel | | | | | |
| 149 | M00042756A:H02 | Cell Cycle | | | SET translocation (myeloid leukemia-associated) | SET | 9 | 9q34 |
| 150 | M00042770D:G04 | | | | hypothetical protein | MAC30 | 17 | 17 |
| 151 | M00042818A:D05 | Unknown | integrase | | | | | |
| 151 | M00054520A:D04 | Unknown | integrase | | | | | |
| 152 | M00054500D:C08 | Unknown | proteasome subunit | | proteasome (prosome, macropain) subunit, alpha type, 7 | PSMA7 | | |
| 153 | M00054538C:C01 | Autophagy | | | Apg12 (autophagy 12, S. cerevisiae)-like | APG12L | 5 | 5q21-q22 |
| 154 | M00054639D:F05 | | GTP binding | nucleocytoplasmic transport? | karyopherin (importin) beta 3 | KPNB3 | | |
| 155 | M00054647A:A09 | Metabolism | glyoxalase | | glyoxalase I | GLO1 | 6 | 6p21.3-p21.1 |
| 156 | M00054650D:E04 | Ribosomal Biogenesis | | | RNA, U22 small nucleolar | RNU22 | 11 | 11q13 |

TABLE 6-continued

| CID | Sample Name or Clone Name | Function | Class | Pathway | GeneAssignment | Gene Symbol | Chromosome Num | Map Position |
|---|---|---|---|---|---|---|---|---|
| 157 | M00054742C:B12 | Unknown | cytokine | | macrophage migration inhibitory factor (glycosylation-inhibiting factor) | MIF | 22 | 22q11.23 |
| 158 | M00054769A:E05 | Translation | ribosomal protein | | ribosomal protein S3A | RPS3A | 4 | 4q31.2-q31.3 |
| 159 | M00054777D:E09 | Unknown | secreted | | carcinoembryonic antigen-related cell adhesion molecule 6 (non-specific cross reacting antigen) | CEACAM6 | 19 | 19q13.2 |
| 160 | M00054806B:G03 | Unknown | snRNA | | | | | |
| 161 | M00054893C:D03 | Unknown | novel | | putative nucleotide binding protein, estradiol-induced [*Homo sapiens*] | E2IG3 | | |
| 162 | M00054971D:D07 | Unknown | novel | | | | 20 | 20q13.2-13.2 |
| 163 | M00055135A:B06 | Unknown | unknown | | hypothetical protein [*Homo sapiens*] | HSPC011 | | |
| 164 | M00055258B:D12 | | | | interferon induced transmembrane protein 2 (1-8D) | IFITM2 | 11 | 11 |
| 165 | M00055406C:D03 | Unknown | kinase | | CDC-like kinase 1 | CLK1 | 2 | 2q33 |
| 166 | M00055435B:A12 | Apoptosis | unknown | | over-expressed breast tumor protein | OBTP | | |
| 167 | M00055583C:B07 | Novel | secreted | | hypothetical protein [*Homo sapiens*] | LOC51316 | | |
| 169 | M00055873C:B06 | Unknown | protease inhibitor | | secretory leukocyte protease inhibitor (antileukoproteinase) | SLPI | | |
| 170 | M00056250C:B02 | | transmembrane | | pituitary tumor-transforming 1 | PTTG1 | 5 | 5q35.1 |
| 171 | M00056301D:A04 | Unknown | unknown | | | | | |
| 172 | M00056308A:F02 | | | sulfate/oxalate Transporter? | down-regulated in adenoma | DRA | 7 | 7q31 |
| 173 | M00056350B:B03 | Cytoskeleton | Ca++ binding | | S100 calcium-binding protein A11 (calgizzarin) | S100A11 | 1 | 1q21 |
| 174 | M00056423A:B06 | Unknown | novel | | hypothetical protein [*Homo sapiens*] | HSPC148 | 11 | 11 |
| 175 | M00056478D:B07 | Unknown | novel | | clone HQ0310 PRO0310p1 [*Homo sapiens*] | LOC51203 | 15 | 15 |
| 176 | M00056483D:G07 | Unknown | protease | | kallikrein 10 | KLK10 | 19 | 19q13 |
| 176 | M00057046A:G09 | Unknown | protease | | kallikrein 10 | KLK10 | 19 | 19q13 |
| 177 | M00056500C:A07 | | | | nascent-polypeptide-associated complex alpha polypeptide | NACA | 12 | 12q23-q24.1 |
| 178 | M00056533D:G07 | Unknown | secreted | | DKFZP434G032 protein [*Homo sapiens*] | DKFZP434G032 | 17 | 17 |
| 179 | M00056534C:E08 | Signal Transduction | secreted | | amphiregulin (schwannoma-derived growth factor) | AREG | 4 | 4q13-q21 |
| 180 | M00056585B:F04 | Unknown | hydrolase | | gamma-glutamyl hydrolase (conjugase, folylpolygammaglutamyl hydrolase) | GGH | | |
| 181 | M00056617D:F07 | Unknown | novel | | | | | |
| 182 | M00056619A:H02 | Cytoskeleton | plastin | | plastin 3 (T isoform) | PLS3 | X | X |
| 183 | M00056622B:F12 | DNA Replication | topoisomerase | | topoisomerase (DNA) II alpha (170 kD) | TOP2A | 17 | 17q21-q22 |
| 184 | M00056632B:H10 | | ATP/GTP binding | | chromosome 20 open reading frame 1 | C20ORF1 | 20 | 20q11.2 |
| 185 | M00056645C:D11 | Metabolism | peroxidase | oxidative metabolism | glutathione peroxidase 1 | GPX1 | 3 | 3p21.3 |
| 186 | M00056646B:F07 | | | | ribosomal protein L7a | RPL7A | 9 | 9q33-q34 |
| 187 | M00056679B:H03 | | | | nucleophosmin (nucleolar phosphoprotein B23, numatrin) | NPM1 | 5 | 5q35 |

TABLE 6-continued

| CID | Sample Name or Clone Name | Function | Class | Pathway | GeneAssignment | Gene Symbol | Chromosome Num | Map Position |
|---|---|---|---|---|---|---|---|---|
| 188 | M00056707D:D05 | Unknown | novel | | | | | |
| 189 | M00056709B:D03 | Unknown | novel | | CGI-138 protein [Homo sapiens] | LOC51649 | 17 | 17 |
| 190 | M00056728C:G02 | Cell Cycle | | | MAD2 (mitotic arrest deficient, yeast, homolog)-like 1 | MAD2L1 | 4 | 4q27 |
| 191 | M00056732B:E02 | Unknown | novel | | LIM domain only 7 | LMO7 | 13 | 13 |
| 192 | M00056810A:A02 | Novel | GTP binding | | hypothetical protein | PTD004 | | |
| 193 | M00056812D:A08 | Unknown | hydrolase | | S-adenosylhomocysteine hydrolase | AHCY | 20 | 20cen-q13.1 |
| 194 | M00056822A:E08 | Signal Transduction | RAS-like | | RAN, member RAS oncogene family | RAN | 6 | 6p21 |
| 195 | M00055209C:B07 | Unknown | novel | | | | 7 | 7p14-p15 |
| 195 | M00056908A:H05 | Unknown | novel | | | | 7 | 7p14-p15 |
| 196 | M00056918C:F09 | Unknown | novel | | hypothetical protein [Homo sapiens] | HSPC152 | 11 | 11 |
| 197 | M00056937C:C10 | Cell Cycle | Ca++ binding | | S100 calcium-binding protein P | S100P | 4 | 4p16 |
| 198 | M00056953B:C09 | Unknown | proteasome subunit | | proteasome (prosome, macropain) activator subunit 2 (PA28 beta) | PSME2 | 14 | 14q11.2 |
| 199 | M00056992C:F12 | Unknown | unknown | | | | | |
| 200 | M00057044D:G03 | Unknown | unknown | | | | 6 | 6 |
| 201 | M00057081B:H03 | Unknown | unknown | | ribosomal protein L10a | RPL10A | | |
| 202 | M00057086D:D08 | Unknown | unknown | | RNA binding motif protein 8 | RBM8 | 1 | 1q12 |
| 203 | M00057126C:B03 | Unknown | novel | | | | | |
| 204 | M00057127B:B09 | Unknown | unknown | | | | | |
| 205 | M00057192B:D02 | Unknown | unknown | | | | | |
| 206 | M00057231A:G04 | Transcription | transcription factor | | non-metastatic cells 2, protein (NM23B) expressed in | NME2 | 17 | 17q21.3 |
| 206 | RG:1651303:10014:E01 | Transcription | transcription factor | | non-metastatic cells 2, protein (NM23B) expressed in | NME2 | 17 | 17q21.3 |
| 207 | M00057241C:F03 | Translation | initiation factor | | eukaryotic translation initiation factor 3, subunit 6 (48 kD) | EIF3S6 | 8 | 8q22-q23 |
| 208 | RG:110764:10005:H04 | | kinase | | protein kinase related to S. cerevisiae STE20, effector for Cdc42Hs | PAK4 | 19 | 19 |
| 210 | RG:1325847:10012:H07 | Unknown | transmembrane | | | | 6 | 6q23 |
| 212 | RG:1353123:10013:A06 | Cell Cycle | phosphatase | | cyclin-dependent kinase inhibitor 3 (CDK2-associated dual specificity phosphatase) | CDKN3 | 14 | 14q22 |
| 212 | RG:1637619:10014:C02 | Cell Cycle | phosphatase | | cyclin-dependent kinase inhibitor 3 (CDK2-associated dual specificity phosphatase) | CDKN3 | 14 | 14q22 |
| 213 | RG:1374447:20004:G01 | Unknown | novel | | | | | |
| 214 | RG:1461567:10013:E03 | Cell Cycle | kinase | | budding uninhibited by benzimidazoles 1 (yeast homolog) | BUB1 | 2 | 2q14 |
| 215 | RG:1525813:10013:F12 | Unknown | novel | | | | 2 | 2 |
| 216 | RG:1552386:10013:G04 | | phosphatase | | acid phosphatase 1, soluble | ACP1 | 2 | 2p25 |
| 217 | RG:1555877:10013:G07 | Metabolism | NADPH oxidase | | neutrophil cytosolic factor 4 (40 kD), isoform 1 [Homo sapiens] | NCF4 | 22 | 22q13.1 |
| 218 | RG:1630930:10014:B05 | nucleic acid synthesis | kinase | | deoxythymidylate kinase | DTYMK | 2 | 2 |
| 219 | RG:1631867:10014:B06 | DNA Repair | Ku protein | dsDNA repair | X-ray repair complementing defective repair in Chinese hamster cells 5 | XRCC5 | 2 | 2q35 |

TABLE 6-continued

| CID | Sample Name or Clone Name | Function | Class | Pathway | GeneAssignment | Gene Symbol | Chromosome Num | Map Position |
|---|---|---|---|---|---|---|---|---|
| 220 | RG:1638979:10014:C04 | Metabolism | GST | drug metabolism | (double-strand-break rejoining; Ku autoantigen, 80 kD) glutathione S-transferase pi | GSTP1 | 11 | 11q13 |
| 221 | RG:1645945:10014:D05 | | proteasome subunit | | proteasome (prosome, macropain) subunit, alpha type, 2 | PSMA2 | 6 | 6q27 |
| 221 | RG:1674393:10014:H02 | | proteasome subunit | | proteasome (prosome, macropain) subunit, alpha type, 2 | PSMA2 | 6 | 6q27 |
| 222 | RG:166410:10006:F01 | Novel | kinase | | | | | |
| 223 | RG:1674098:10014:H01 | Unknown | unknown | | myristoylated alanine-rich protein kinase C substrate (MARCKS, 80K-L) | MACS | 6 | 6q22.2 |
| 224 | RG:180296:10006:G03 | | kinase | | protein tyrosine kinase 2 beta | PTK2B | 8 | 8p21.1 |
| 225 | RG:1838677:10015:E10 | | kinase | | membrane-associated tyrosine- and threonine-specific cdc2-inhibitory kinase | PKMYT1 | | |
| 226 | RG:1861510:20001:B03 | Unknown | novel | | | | | |
| 227 | RG:1895716:10015:G09 | Novel | kinase | | | | 14 | 14 |
| 228 | RG:1927470:10015:H08 | Metabolism | kinase | glycolysis | phosphoglycerate kinase 1 | PGK1 | X | Xq13 |
| 229 | RG:1996788:20003:C10 | Unknown | novel | | | | | |
| 230 | RG:1996901:20003:D01 | Unknown | novel | | | | | |
| 231 | RG:2002384:20003:E01 | Unknown | novel | | | | | |
| 232 | RG:2006302:20003:F08 | Unknown | novel | | | | | |
| 233 | RG:2006592:20003:F12 | Unknown | novel | | | | 12 | |
| 235 | RG:2012168:10016:B05 | Metabolism | hydrolase | | phosphoribosyl pyrophosphate amidotransferase | PPAT | 4 | 4q12 |
| 236 | RG:203031:10007:A09 | Unknown | kinase | | serine/threonine kinase 15 | STK15 | 20 | 20q13.2-q13.3 |
| 236 | RG:781507:10011:E01 | Unknown | kinase | | serine/threonine kinase 15 | STK15 | 20 | 20q13.2-q13.3 |
| 237 | RG:2048081:10016:B08 | | kinase | | mitogen-activated protein kinase 10 | MAPK10 | | |
| 238 | RG:2051667:20003:H05 | Unknown | novel | | | | 1 | 1 |
| 239 | RG:2055807:10016:B09 | Unknown | kinase | | | | 20 | 20p12.2-13 |
| 240 | RG:208954:10007:B12 | | kinase | | | | | Xq25-26.3 |
| 241 | RG:2097257:10016:C07 | Unknown | protease | | serine protease, umbilical endothelium | SPUVE | 12 | 12 |
| 242 | RG:2097294:10016:C08 | Mitochondrial | transferase | thymidylate synthase metabolic cycle | serine hydroxymethyltransferase 2 (mitochondrial) | SHMT2 | 12 | 12q12-q14 |
| 243 | RG:2117694:10016:E01 | Unknown | kinase | | serine/threonine kinase 11 (Peutz-Jeghers syndrome) | STK11 | 19 | 19p13.3 |
| 244 | RG:241029:10007:D07 | Unknown | kinase | | serine/threonine kinase 12 | STK12 | 17 | 17p13.1 |
| 245 | RG:244132:10007:E01 | | kinase | | serum/glucocorticoid regulated kinase-like | SGKL | 8 | 8q12.3-8q13.1 |
| 246 | RG:244601:10007:E02 | Cell Cycle | kinase | | cyclin-dependent kinase 5 | CDK5 | 7 | 7q36 |
| 247 | RG:27403:10004:E11 | Novel | transmembrane | | | | | |
| 248 | RG:278409:10008:B10 | Unknown | kinase | | mitogen-activated protein kinase kinase 4 | MAP2K4 | 17 | 17p11.2 |
| 249 | RG:29739:10004:F02 | Cell Cycle | kinase | | TTK protein kinase | TTK | 6 | 6q13-q21 |
| 250 | RG:301608:10008:D09 | | kinase | | serine/threonine-protein kinase PRP4 homolog | PRP4 | | |
| 251 | RG:306813:10008:E12 | | kinase | | v-ros avian UR2 sarcoma virus oncogene homolog 1 | ROS1 | 6 | 6q22 |
| 252 | RG:1635546:10014:B08 | Ribosomal Biogenesis | | | nucleolar protein (KKE/D repeat) | NOP56 | 20 | 20 |
| 252 | RG:323425:10008:F11 | Ribosomal Biogenesis | | | nucleolar protein (KKE/D repeat) | NOP56 | 20 | 20 |

TABLE 6-continued

| CID | Sample Name or Clone Name | Function | Class | Pathway | GeneAssignment | Gene Symbol | Chromosome Num | Map Position |
|---|---|---|---|---|---|---|---|---|
| 253 | RG:343821:10008:H05 | | kinase | | TYRO3 protein tyrosine kinase | TYRO3 | 15 | 15q15.1-q21.1 |
| 254 | RG:35892:10004:H10 | | kinase | | activin A receptor, type I | ACVR1 | 2 | 2q23-q24 |
| 255 | RG:364972:10009:B06 | Unknown | novel | | | | 19 | 19 |
| 256 | RG:376554:10009:B12 | Unknown | novel | | | | 8 | 8 |
| 257 | RG:417109:10009:D09 | Unknown | novel | | | | 9 | 9 |
| 258 | RG:43296:10005:C03 | | kinase | | SFRS protein kinase 2 | SRPK2 | 7 | 7q22-q31.1 |
| 259 | RG:432960:10009:E11 | Transcription | deacetylase | | retinoblastoma-binding protein 7 | RBBP7 | | |
| 260 | RG:43534:10005:C04 | | kinase | | ribosomal protein S6 kinase, 90 kD, polypeptide 1 | RPS6KA1 | 3 | 3 |
| 261 | RG:45623:10005:D09 | Unknown | novel | | HSKM-B protein | HSKM-B | | |
| 262 | RG:471154:10009:H04 | | protease inhibitor | | tissue inhibitor of metalloproteinase 3 (Sorsby fundus dystrophy, pseudoinflammatory) | TIMP3 | 22 | 22q12.3 |
| 263 | RG:487171:10009:H09 | Unknown | kinase | | polo (*Drosophia*)-like kinase | PLK | | |
| 264 | RG:526536:10002:A02 | | kinase | | solute carrier family 9 (sodium/hydrogen exchanger), isoform 3 regulatory factor 2 | SLC9A3R2 | 16 | 16p13.3 |
| 265 | RG:530002:10002:A08 | | kinase | | EphA3 | EPHA3 | 3 | 3p11.2 |
| 266 | RG:612874:10002:G02 | | kinase | | serum-inducible kinase | SNK | 5 | 5 |
| 267 | RG:665547:10010:B04 | Unknown | novel | | | | 2 | 2 |
| 268 | RG:665682:10010:B05 | Unknown | kinase | | mitogen-activated protein kinase kinase 7 | MAP2K7 | | |
| 269 | RG:666323:10010:B07 | | kinase | | sterile-alpha motif and leucine zipper containing kinase AZK [*Homo sapiens*] | ZAK | 2 | 2q24.2 |
| 270 | RG:669110:10010:B12 | Novel | kinase | | | | | |
| 271 | RG:686594:10010:D03 | Cell Cycle | kinase | | KIAA0965 protein | KIAA0965 | 12 | 12 |
| 273 | RG:729913:10010:G11 | Unknown | kinase | | | | 14 | 14 |
| 274 | RG:740831:10010:H12 | | kinase | | v-rafmurine sarcoma 3611 viral oncogene homolog 1 | ARAF1 | X | Xp11.4-p11.2 |
| 276 | RG:742764:10011:A06 | RNA splicing | | | splicing factor, arginine/serine-rich 3 | SFRS3 | | |
| 277 | RG:781028:10011:D08 | | kinase | | mitogen-activated protein kinase kinase kinase 3 | MAP4K3 | | |
| 278 | RG:785368:10011:E11 | Novel | kinase | | PDZ-binding kinase; T-cell originated protein kinase | TOPK | 8 | 8p21-p12 |
| 278 | RG:785846:10011:F02 | Novel | kinase | | PDZ-binding kinase; T-cell originated protein kinase | TOPK | 8 | 8p21-p12 |
| 280 | RG:985973:10012:B09 | Unknown | kinase | | v-akt murine thymoma viral oncogene homolog 3 (protein kinase B, gamma) | AKT3 | 1 | 1q43-q44 |
| 291 | M00022140A:E11 M00054510D:F09 RG:742775:10011:A07 RG:759927:10011:C09 RG:773612:10011:D06 RG:813679:10011:H03 | Chaperone | HSP90 | | heat shock 90 kD protein 1, beta | HSPCB | 6 | 6p12 |

The differential expression assay was performed by mixing equal amounts of probes from tumor cells and normal cells of the same patient. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p > 10^{-3}$, and the differential ratio was set to 1.000 for those spots. All other spots have a significant difference in expression between the tumor and normal sample. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level ($p > 0.05$).

Table 7 (incorporated by reference to a compact disk) provides the results for gene products differentially expressed in the colon tumor samples relative to normal tissue samples. Table 7 includes: 1) the SEQ ID No; 2) the CID or candidate identification number; 3) the spot identification number ("SpotID"); 4) the percentage of patients tested in which expression levels of the gene was at least 2-fold greater in cancerous tissue than in matched normal tissue (">=2×"); 5) the percentage of patients tested in which expression levels of the gene was at least 2.5-fold greater in cancerous tissue than in matched normal tissue (">=2.5×"); 6) the percentage of patients tested in which expression levels of the gene was at least 5-fold greater in cancerous tissue than in matched normal cells (">=5×"); 7) the percentage of patients tested in which expression levels of the gene was less than or equal to ½ of the expression level in matched normal cells ("<=halfx"); and 8) the number of patients tested for each sequence. Table 7 also includes the results from each patient, identified by the patient ID number (e.g., 15Ratio). This data represents the ratio of differential expression for the samples tested from that particular patient's tissues (e.g., "15Ratio" is the ratio from the tissue samples of patient ID no. 15). The ratios of differential expression is expressed as a normalized hybridization signal associated with the tumor probe divided by the normalized hybridization signal with the normal probe. Thus, a ratio greater than 1 indicates that the gene product is increased in expression in cancerous cells relative to normal cells, while a ratio of less than 1 indicates the opposite.

These data provide evidence that the genes represented by the polynucleotides having the indicated sequences are differentially expressed in colon cancer.

Example 3

Antisense Regulation of Gene Expression

The expression of the differentially expressed genes represented by the polynucleotides in the cancerous cells was analyzed using antisense knockout technology to confirm the role and function of the gene product in tumorigenesis, e.g., in promoting a metastatic phenotype.

A number of different oligonucleotides complementary to the mRNA generated by the differentially expressed genes identified herein were designed as potential antisense oligonucleotides, and tested for their ability to suppress expression of the genes. Sets of antisense oligomers specific to each candidate target were designed using the sequences of the polynucleotides corresponding to a differentially expressed gene and the software program HYBsimulator Version 4 (available for Windows 95/Windows NT or for Power Macintosh, RNAture, Inc. 1003 Health Sciences Road, West, Irvine, Calif. 92612 USA). Factors considered when designing antisense oligonucleotides include: 1) the secondary structure of oligonucleotides; 2) the secondary structure of the target gene; 3) the specificity with no or minimum cross-hybridization to other expressed genes; 4) stability; 5) length and 6) terminal GC content. The antisense oligonucleotide is designed to so that it will hybridize to its target sequence under conditions of high stringency at physiological temperatures (e.g., an optimal temperature for the cells in culture to provide for hybridization in the cell, e.g., about 37° C.), but with minimal formation of homodimers.

Using the sets of oligomers and the HYBsimulator program, three to ten antisense oligonucleotides and their reverse controls were designed and synthesized for each candidate mRNA transcript, which transcript was obtained from the gene corresponding to the target polynucleotide sequence of interest. Once synthesized and quantitated, the oligomers were screened for efficiency of a transcript knock-out in a panel of cancer cell lines. The efficiency of the knock-out was determined by analyzing mRNA levels using lightcycler quantification. The oligomers that resulted in the highest level of transcript knock-out, wherein the level was at least about 50%, preferably about 80-90%, up to 95% or more up to undetectable message, were selected for use in a cell-based proliferation assay, an anchorage independent growth assay, and an apoptosis assay.

The ability of each designed antisense oligonucleotide to inhibit gene expression was tested through transfection into SW620 colon colorectal carcinoma cells. For each transfection mixture, a carrier molecule, preferably a lipitoid or cholesteroid, was prepared to a working concentration of 0.5 mM in water, sonicated to yield a uniform solution, and filtered through a 0.45 µm PVDF membrane. The antisense or control oligonucleotide was then prepared to a working concentration of 100 µM in sterile Millipore water. The oligonucleotide was further diluted in OptiMEM™ (Gibco/BRL), in a microfuge tube, to 2 µM, or approximately 20 µg oligo/ml of OptiMEM™. In a separate microfuge tube, lipitoid or cholesteroid, typically in the amount of about 1.5-2 nmol lipitoid/pg antisense oligonucleotide, was diluted into the same volume of OptiMEM™ used to dilute the oligonucleotide. The diluted antisense oligonucleotide was immediately added to the diluted lipitoid and mixed by pipetting up and down. Oligonucleotide was added to the cells to a final concentration of 30 nM.

The level of target mRNA that corresponds to a target gene of interest in the transfected cells was quantitated in the cancer cell lines using the Roche LightCycler™ real-time PCR machine. Values for the target mRNA were normalized versus an internal control (e.g., beta-actin). For each 20 µl reaction, extracted RNA (generally 0.2-1 µg total) was placed into a sterile 0.5 or 1.5 ml microcentrifuge tube, and water was added to a total volume of 12.5 µl. To each tube was added 7.5 µl of a buffer/enzyme mixture, prepared by mixing (in the order listed) 2.5 µl $H_2O$, 2.0 µl 10× reaction buffer, 10 µl oligo dT (20 pmol), 1.0 µl dNTP mix (10 mM each), 0.5 µl RNAsin® (20 u) (Ambion, Inc., Hialeah, Fla.), and 0.5 µl MMLV reverse transcriptase (50 u) (Ambion, Inc.). The contents were mixed by pipetting up and down, and the reaction mixture was incubated at 42° C. for 1 hour. The contents of each tube were centrifuged prior to amplification.

An amplification mixture was prepared by mixing in the following order: 1×PCR buffer II, 3 mM $MgCl_2$, 140 µM each dNTP, 0.175 pmol each oligo, 1:50,000 dil of SYBR® Green, 0.25 mg/ml BSA, 1 unit Taq polymerase, and $H_2O$ to 20 µl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 µl aliquot of amplification mixture 2 µl of template RT was added, and amplification was carried out according to standard protocols.

The results of the antisense assays are provided in Table 8. The results are expressed as the percent decrease in expression of the corresponding gene product relative to non-transfected cells, vehicle-only transfected (mock-transfected) cells, or cells transfected with reverse control oligonucleotides. Table 8 includes: 1) the SEQ ID NO; 2) the CID; 3) the "Gene Assignment" which refers to the gene to which the sequence has the greatest homology or identity; 4) the "Gene Symbol"; 5) GenBank gene name; and 6) the percent decrease in expression of the gene relative to control cells ("mRNA KO").

TABLE 8

| SEQ ID NO | CID | Gene Assignment | Gene Symbol | GenBank Gene Name | mRNA KO |
|---|---|---|---|---|---|
| 4 | 1 | Homo sapiens S100 calcium-binding protein A4 (calcium protein, calvasculin, metastasin, murine placental homolog) (S100A4) mRNA > :: gb|M80563|HUMCAPL Human CAPL protein mRNA, complete cds. | S100A | S100A4 | >80% |
| 9 | 6 | CDC28 protein kinase 2 | CKS2 | CKS2 01/11 | >80% |
| 11 | 8 | Fn14 for type I transmenmbrane protein | LOC51330 | Fn14 | >90% |
| 12 | 9 | cadherin 3, P-cadherin (placental) | CDH3 | CADHERIN-P | >90% |
| 16 | 13 | kallikrein 6 (neurosin, zyme) | KLK6 | proteaseM | >80% |
| 17 | 14 | arachidonate 5-lipoxygenase | ALOX5 | ALOX5 | >80% |
| 22 | 18 | bone morphogenetic protein 4 | BMP4 | BMP4 | >90% |
| 25 | 21 | | | GSTHOM | >90% |
| 32 | 27 | cathepsin H | CTSH | CATH-H | >90% |
| 38 | 33 | transketolase (Wernicke-Korsakoff syndrome) | TKT | TRANSKETOLASE | >90% |
| 41 | 36 | fucosyltransferase 1 (galactoside 2-alpha-L-fucosyltransferase, Bombay phenotype included) | FUT1 | FUT1 | >90% |
| 42 | 37 | 6-pyruvoyl-tetrahydropterin synthase/dimerization cofactor of hepatocyte nuclear factor 1 alpha (TCF1) | PCBD | hDohc | >95% |
| 54 | 50 | | | THC271862 | >70% |
| 56 | 53 | | | hECT2 | >80% |
| 63 | 63 | dipeptidase 1 (renal) | DPEP1 | DPP | >80% |
| 71 | 74 | ClpP (caseinolytic protease, ATP-dependent, proteolytic subunit, E. coli) homolog | CLPP | CLPP | >80% |
| 77 | 75 | tetraspan 5 | TSPAN-5 | NET-4 | >90% |
| 78 | 76 | phosphoserine aminotransferase | PSA | serAT | >90% |
| 87 | 121 | EGF-like-domain, multiple 2 | EGFL2 | EGFL2 | >70% |
| 100 | 127 | sigma receptor (SR31747 binding protein 1) | SR-BP1 | SR-BP1 | >90% |
| 113 | 92 | tumor protein D52-like 1 | TPD52L1 | hD53 | >80% |
| 141 | 143 | sulfotransferase family 2B, member 1 | SULT2B1 | SULT2B1 | >80% |
| 147 | 166 | over-expressed breast tumor protein | OBTP | HUMTUM | >90% |
| 165 | 179 | amphiregulin (schwannoma-derived growth factor) | AREG | AREG | >90% |
| 180 | 193 | S-adenosylhomocysteine hydrolase | AHCY | HUMAHCY2 | >70% |
| 183 | 196 | hypothetical protein [Homo sapiens] | HSPC152 | c719 | >80% |
| 208 | 155 | glyoxalase I | GLO1 | GLO1 | >90% |
| 213 | 160 | | | c374641 | >80% |
| 214 | 161 | putative nucleotide binding protein, estradiol-induced [Homo sapiens] | E2IG3 | c454001 | >80% |
| 218 | 164 | interferon induced transmembrane protein 2 (1-8D) | IFITM2 | 1-8U | >90% |
| 233 | 263 | polo (Drosophia)-like kinase | PLK | PLK1 | >90% |
| 236 | 266 | serum-inducible kinase | SNK | SNK | >80% |

TABLE 8-continued

| SEQ ID NO | CID | GeneAssignment | Gene Symbol | GenBank Gene Name | mRNA KO |
|---|---|---|---|---|---|
| 239 | 269 | sterile-alpha motif and leucine zipper containing kinase AZK [Homo sapiens] | ZAK | AZK | >70% |
| 242 | 273 | | | AA399596 | >70% |
| 253 | 280 | v-akt murine thymoma viral oncogene homolog 3 (protein kinase B, gamma) | AKT3 | AKT3 | >90% |
| 276 | 227 | | | ITAK1 | >90% |
| 279 | 239 | | | AI335279 | >90% |
| 285 | 242 | serine hydroxymethyltransferase 2 (mitochondrial) | SHMT2 | SHMT2 | >90% |
| 294 | 245 | serum/glucocorticoid regulated kinase-like | SGKL | SGKL | >90% |
| 295 | 248 | mitogen-activated protein kinase kinase 4 | MAP2K4 | MKK4 | >80% |
| 300 | 249 | TTK protein kinase | TTK | hTTK | >90% |
| 123, 124 | 103 | stearoyl-CoA desaturase | SCD | SCD | >90% |
| 130, 228 | 115 | prostate differentiation factor | PLAB | PLAB | >80% |
| 162, 193 | 176 | kallikrein 10 | KLK10 | NES1 | >80% |
| 182, 217 | 195 | | | c1665 | >80% |
| 247, 290 | 236 | serine/threonine kinase 15 | STK15 | hARK2 | >80% |
| 257, 268 | 212 | cyclin-dependent kinase inhibitor 3 (CDK2-associated dual specificity phosphatase) | CDKN3 | KAP | >85% |
| 31, 151 | 170 | pituitary tumor-transforming 1 | PTTG1 | PTTG1 | >90% |
| 35, 150 | 30 | CDC28 protein kinase 1 | CKS1 | CKS1 | >80% |
| 5, 298, 301 | 2 | EphB3 [Homo sapiens] | EPHB3 | EPHB3 | >90% |
| 65, 220 | 65 | KIAA0101 gene product [Homo sapiens] | KIAA0101 | KIAA0101 | >80% |
| 73, 116 | 100 | KIAA0175 gene product [Homo sapiens] | KIAA0175 | KIAA0175 | >90% |
| 75, 131, 134 | 106 | catenin (cadherin-associated protein), alpha-like 1 | CTNNAL1 | RTA000001 79AF.k.22.1 | >90% |
| 8, 106 | 5 | AXL receptor tyrosine kinase | AXL | | >95% |
| 88, 196 | 118 | | | c3376 | >80% |

Example 4

Effect of Expression on Proliferation

The effect of gene expression on the inhibition of cell proliferation was assessed in metastatic breast cancer cell lines (MDA-MB-231 ("231")), SW620 colon colorectal carcinoma cells, or SKOV3 cells (a human ovarian carcinoma cell line).

Cells were plated to approximately 60-80% confluency in 96-well dishes. Antisense or reverse control oligonucleotide was diluted to 2 μM in OptiMEM™ and added to OptiMEM™ into which the delivery vehicle, lipitoid 116-6 in the case of SW620 cells or 1:1 lipitoid 1:cholesteroid 1 in the case of MDA-MB-231 cells, had been diluted. The oligo/delivery vehicle mixture was then further diluted into medium with serum on the cells. The final concentration of oligonucleotide for all experiments was 300 nM, and the final ratio of oligo to delivery vehicle for all experiments was 1.5 nmol lipitoid/μg oligonucleotide.

Antisense oligonucleotides were prepared as described above (see Example 3). Cells were transfected overnight at 37° C. and the transfection mixture was replaced with fresh medium the next morning. Transfection was carried out as described above in Example 3.

The results of the antisense experiments are shown in Table 9, column labeled "Proliferation"). Those antisense oligonucleotides that resulted in decreased proliferation in SW620 colorectal carcinoma cells are indicated by "Inhib in" and "weak effect in", with the cell type following. Those antisense oligonucleotides that resulted in inhibition of proliferation of SW620 cells indicates that the corresponding gene plays a role in production or maintenance of the cancerous phenotype in cancerous colon cells. Those antisense oligonucleotides that inhibited proliferation in SKOV3 cells represent genes that play a role in production or maintenance of the cancerous phenotype in cancerous breast cells. Those antisense oligonucleotides that resulted in inhibition of proliferation of MDA-MB-231 cells indicates that the corresponding gene plays a role in production or maintenance of the cancerous phenotype in cancerous ovarian cells.

TABLE 9

| SEQ ID NO | CID | GeneAssignment | Gene Symbol | Gene | mRNA KO | Proliferation | Softagar |
|---|---|---|---|---|---|---|---|
| 4 | 1 | *Homo sapiens* S100 calcium-binding protein A4 (calcium protein, calvasculin, metastasin, murine placental homolog) (S100A4) mRNA > :: gb\|M80563\|HUMCAPL Human CAPL protein mRNA, complete cds. | S100A | S100A4 | >80% | Inhib in SW620 | weak inhibition |
| 11 | 8 | Fn14 for type I transmenmbrane protein | LOC51330 | Fn14 | >90% | inconsis. SW620, 231 | inhibits SW620, 231 |
| 12 | 9 | cadherin 3, P-cadherin (placental) | CDH3 | CADHERIN-P | >90% | Inhib in SW620 | Inhib in SW620 |
| 16 | 13 | kallikrein 6 (neurosin, zyme) | KLK6 | proteaseM | >80% | weak effect in SW620 | negative SW620 |
| 38 | 33 | transketolase (Wernicke-Korsakoff syndrome) | TKT | TRANSKETOLASE | >90% | inconsis. SW620, 231 | inhibits SW620, 231 |
| 42 | 37 | 6-pyruvoyl-tetrahydropterin synthase/dimerization cofactor of hepatocyte nuclear factor 1 alpha (TCF1) | PCBD | hDohc | >95% | inconsis. SW620, 231 | inhibits SW620, 231 |
| 56 | 53 | | | hECT2 | >80% | Inhib in SW620 | Inhib in SW620 |
| 63 | 63 | dipeptidase 1 (renal) | DPEP1 | DPP | >80% | weak inhibition | negative in SW620 |
| 77 | 75 | tetraspan 5 | TSPAN-5 | NET-4 | >90% | Inhib in SW620 | weak inhibition |
| 180 | 193 | S-adenosylhomocysteine hydrolase | AHCY | HUMAHCY 2 | >70% | Inhib in SW620 | Inhib in SW620 |
| 233 | 263 | polo (*Drosophia*)-like kinase | PLK | PLK1 | >90% | Inhib in SW620 | Inhib in SW620 |
| 236 | 266 | serum-inducible kinase | SNK | SNK | >80% | Inhib in SW620 | negative in SW620 |
| 253 | 280 | v-akt murine thymoma viral oncogene homolog 3 (protein kinase B, gamma) | AKT3 | AKT3 | >90% | inhibits SKOV3, 231 | inhibits SKOV3, 231 |
| 279 | 239 | | | AI335279 | >90% | negative in SW620 | weak inhibition |
| 300 | 249 | TTK protein kinase | TTK | hTTK | >90% | inhibits SW620 | inhibits SW620 |
| 247, 290 | 236 | serine/threonine kinase 15 | STK15 | hARK2 | >80% | Inhib in SW620 | weak effect in SW620 |
| 257, 268 | 212 | cyclin-dependent kinase inhibitor 3 (CDK2-associated dual specificity phosphatase) | CDKN3 | KAP | >85% | Inhib in SW620 | |
| 35, 150 | 30 | CDC28 protein kinase 1 | CKS1 | CKS1 | >80% | Inhib in SW620 | Inhib in SW620 |
| 88, 196 | 118 | | | c3376 | >80% | weak effect in SW620 | neg SW620 |

Example 5

Effect of Gene Expression on Colony Formation

The effect of gene expression upon colony formation of SW620 cells, SKOV3 cells, and MD-MBA-231 cells was tested in a soft agar assay. Soft agar assays were conducted by first establishing a bottom layer of 2 ml of 0.6% agar in media plated fresh within a few hours of layering on the cells. The cell layer was formed on the bottom layer by removing cells transfected as described above from plates using 0.05% trypsin and washing twice in media. The cells were counted in a Coulter counter, and resuspended to $10^6$ per ml in media. 10 μl aliquots were placed with media in 96-well plates (to check counting with WST1), or diluted further for the soft agar assay. 2000 cells were plated in 800 μl 0.4% agar in duplicate wells above 0.6% agar bottom layer. After the cell layer agar solidified, 2 ml of media was dribbled on top and antisense or reverse control oligo (produced as described in Example 3) was added without delivery vehicles. Fresh media and oligos were added every 3-4 days. Colonies formed in 10 days to 3 weeks. Fields of colonies were counted by eye. Wst-1 metabolism values can be used to compensate for small differences in starting cell number. Larger fields can be scanned for visual record of differences.

Table 9 provides the results of these assays ("Softagar"). Those antisense oligonucleotides that resulted in inhibition of colony formation are indicated by "inhibits", "weak effect", or "weak inhibition" followed by the cell type. Those antisense oligonucleotides that resulted in inhibition of colony formation of SW620 cells indicates that the corresponding gene plays a role in production or maintenance of the cancerous phenotype in cancerous colon cells. Those antisense oligonucleotides that inhibited colony formation in SKOV3 cells represent genes that play a role in production or maintenance of the cancerous phenotype in cancerous breast cells. Those antisense oligonucleotides that resulted in inhibition of colony formation of MDA-MB-231 cells indicates that the corresponding gene plays a role in production or maintenance of the cancerous phenotype in cancerous ovarian cells.

Example 6

Induction of Cell Death Upon Depletion of Polypeptides by Depletion of mRNA ("Antisense Knockout")

In order to assess the effect of depletion of a target message upon cell death, SW620 cells, or other cells derived from a cancer of interest, are transfected for proliferation assays. For cytotoxic effect in the presence of cisplatin (cis), the same protocol is followed but cells are left in the presence of 2 μM drug. Each day, cytotoxicity was monitored by measuring the amount of LDH enzyme released in the medium due to membrane damage. The activity of LDH is measured using the Cytotoxicity Detection Kit from Roche Molecular Biochemicals. The data is provided as a ratio of LDH released in the medium vs. the total LDH present in the well at the same time point and treatment (rLDH/tLDH). A positive control using antisense and reverse control oligonucleotides for BCL2 (a known anti-apoptotic gene) is included; loss of message for BCL2 leads to an increase in cell death compared with treatment with the control oligonucleotide (background cytotoxicity due to transfection).

Example 7

Functional Analysis of Gene Products Differentially Expressed in Colon Cancer in Patients The gene products of sequences of a gene differentially expressed in cancerous cells can be further analyzed to confirm the role and function of the gene product in tumorigenesis, e.g., in promoting or inhibiting development of a metastatic phenotype. For example, the function of gene products corresponding to genes identified herein can be assessed by blocking function of the gene products in the cell. For example, where the gene product is secreted or associated with a cell surface membrane, blocking antibodies can be generated and added to cells to examine the effect upon the cell phenotype in the context of, for example, the transformation of the cell to a cancerous, particularly a metastatic, phenotype.

Where the gene product of the differentially expressed genes identified herein exhibits sequence homology to a protein of known function (e.g., to a specific kinase or protease) and/or to a protein family of known function (e.g., contains a domain or other consensus sequence present in a protease family or in a kinase family), then the role of the gene product in tumorigenesis, as well as the activity of the gene product, can be examined using small molecules that inhibit or enhance function of the corresponding protein or protein family.

Additional functional assays include, but are not necessarily limited to, those that analyze the effect of expression of the corresponding gene upon cell cycle and cell migration. Methods for performing such assays are well known in the art.

Example 8

Contig Assembly and Additional Gene Characterization

The sequences of the polynucleotides provided in the present invention can be used to extend the sequence information of the gene to which the polynucleotides correspond (e.g., a gene, or mRNA encoded by the gene, having a sequence of the polynucleotide described herein). This expanded sequence information can in turn be used to further characterize the corresponding gene, which in turn provides additional information about the nature of the gene product (e.g., the normal function of the gene product). The additional information can serve to provide additional evidence of the gene product's use as a therapeutic target, and provide further guidance as to the types of agents that can modulate its activity.

In one example, a contig was assembled using the sequence of the polynucleotide having SEQ ID NO:2 (sequence name 019.G3.sp6__128473), which is present in clone M00006883D:H12. A "contig" is a contiguous sequence of nucleotides that is assembled from nucleic acid sequences having overlapping (e.g., shared or substantially similar) sequence information. The sequences of publicly-available ESTs (Expressed Sequence Tags) and the sequences of various clones from several cDNA libraries synthesized at Chiron were used in the contig assembly. None of the sequences from these latter clones from the cDNA libraries had significant hits against known genes with function when searched using BLASTN against GenBank as described above.

The contig was assembled using the software program Sequencher, version 4.05, according to the manufacturer's instructions. The final contig was assembled from 11 sequences, provided in the Sequence Listing as SEQ ID NOS:2 and 310-320. The sequence names and SEQ ID NOS of the sequences are provided in the overview alignment produced by Sequencher (see FIG. 1).

The clone containing the sequence of 035JN032.H09 (SEQ ID NO:319) is of particular interest. This clone was originally obtained from a normalized cDNA library prepared from a prostate cancer tissue sample that was obtained from a patient with Gleason grade 3+3. The clone having the 035JN032.H09 sequence corresponds to a gene that has increased expression in (e.g., is upregulated) in colon cancer as detected by microarray analysis using the protocol and materials described above. The data is provided in Table 10 below.

TABLE 10

| SEQ ID NO | Spot ID | Chip # | Sample ID | Number of patients used to calculate concordance | % >=2x | % >=5x |
|---|---|---|---|---|---|---|
| 2 | 1833 | 1 | M00006883D:H12 | 33 | 61 | 33 |
| 319 | 27454 | 5 | 035JN032.H09 | 28 | 61 | 11 |

"%>2x" and "%>5x" indicate the percentage of patients in which the corresponding gene was expressed at two-fold and five-fold greater levels in cancerous cells relative to normal cells, respectively.

This observation thus further validates the expression profile of the clone having the sequence of 035JN032.H09, as it indicates that the gene represented by this sequence and clone is differentially expressed in at least two different cancer types.

The sequence information obtained in the contig assembly described above was used to obtain a consensus sequence derived from the contig using the Sequencer program. The consensus sequence is provided as SEQ ID NO:320 in the Sequence Listing.

In preliminary experiments, the consensus sequence was used as a query sequence in a BLASTN search of the DGTI DoubleTwist Gene Index (DoubleTwist, Inc., Oakland, Calif.), which contains all the EST and non-redundant sequence in public databases. This preliminary search indicated that the consensus sequence has homology to a predicted gene homologue to human atrophin-1 (HSS0190516.1 dtgic|HSC010416.3 Similar to: DRPL_HUMAN gi|17660|sp|P54259|DRPL_HUMAN ATROPHIN-1 (DENTATORUBRAL-PALLIDOLUYSIAN ATROPHY PROTEIN) [*Homo sapiens* (Human), provided as SEQ ID NO:322), with a Score=1538 bits (776), Expect=0.0, and Identities=779/780 (99%).

While the preliminary results regarding the homology to atrophin-1 are not yet confirmed, this example, through contig assembly and the use of homology searching software programs, shows that the sequence information provided herein can be readily extended to confirm, or confirm a predicted, gene having the sequence of the polynucleotides described in the present invention. Further the information obtained can be used to identify the function of the gene product of the gene corresponding to the polynucleotides described herein. While not necessary to the practice of the invention, identification of the function of the corresponding gene, can provide guidance in the design of therapeutics that target the gene to modulate its activity and modulate the cancerous phenotype (e.g., inhibit metastasis, proliferation, and the like).

Example 9

Source of Biological Materials

The biological materials used in the experiments that led to the present invention are described below.

Source of Patient Tissue Samples

Normal and cancerous tissues were collected from patients using laser capture microdissection (LCM) techniques, which techniques are well known in the art (see, e.g., Ohyama et al. (2000) Biotechniques 29:530-6; Curran et al. (2000) Mol. Pathol. 53:64-8; Suarez-Quian et al. (1999) Biotechniques 26:328-35; Simone et al. (1998) Trends Genet 14:272-6; Conia et al. (1997) J. Clin. Lab. Anal. 11:28-38; Emmert-Buck et al. (1996) Science 274:998-1001). Table 11 provides information about each patient from which colon tissue samples were isolated, including: the Patient ID ("PT ID") and Path ReportID ("Path ID"), which are numbers assigned to the patient and the pathology reports for identification purposes; the group ("Grp") to which the patients have been assigned; the anatomical location of the tumor ("Anatom Loc"); the primary tumor size ("Size"); the primary tumor grade ("Grade"); the identification of the histopathological grade ("Histo Grade"); a description of local sites to which the tumor had invaded ("Local Invasion"); the presence of lymph node metastases ("Lymph Met"); the incidence of lymph node metastases (provided as a number of lymph nodes positive for metastasis over the number of lymph nodes examined) ("Lymph Met Incid"); the regional lymphnode grade ("Reg Lymph Grade"); the identification or detection of metastases to sites distant to the tumor and their location ("Dist Met & Loc"); the grade of distant metastasis ("Dist Met Grade"); and general comments about the patient or the tumor ("Comments"). Histopatology of all primary tumors indicated the tumor was adenocarcinoma except for Patient ID Nos. 130 (for which no information was provided), 392 (in which greater than 50% of the cells were mucinous carcinoma), and 784 (adenosquamous carcinoma). Extranodal extensions were described in three patients, Patient ID Nos. 784 and 791. Lymphovascular invasion was described in Patient ID Nos. 128, 228, 278, 517, 784, 786, 791, and 890. Crohn's-like infiltrates were described in seven patients, Patient ID Nos. 52, 264, 268, 392, 393, 784, and 791.

TABLE 11

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 15 | 21 | III | Ascending colon | 4.0 | T3 | G2 | Extending into subserosal adipose tissue | Pos | 3/8 | N1 | Neg | MX | invasive adenocarcinoma, moderately differentiated; focal perineural invasion is seen |
| 52 | 71 | II | Cecum | 9.0 | T3 | G3 | Invasion through muscularis propria, subserosal involvement; ileocec. valve involvement | Neg | 0/12 | N0 | Neg | M0 | Hyperplastic polyp in appendix. |
| 121 | 140 | II | Sigmoid | 6 | T4 | G2 | Invasion of muscularis propria into serosa, involving submucosa of urinary bladder | Neg | 0/34 | N0 | Neg | M0 | Perineural invasion; donut anastomosis Neg. One tubulovillous |

TABLE 11-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 125 | 144 | II | Cecum | 6 | T3 | G2 | Invasion through the muscularis propria into suserosal adipose tissue. Ileocecal junction. | Neg | 0/19 | N0 | Neg | M0 | and one tubular adenoma with no high grade dysplasia. patient history of metastatic melanoma |
| 128 | 147 | III | Transverse colon | 5.0 | T3 | G2 | Invasion of muscularis propria into percolonic fat | Pos | 1/5 | N1 | Neg | M0 | |
| 130 | 149 | | Splenic flexure | 5.5 | T3 | | through wall and into surrounding adipose tissue | Pos | 10/24 | N2 | Neg | M1 | |
| 133 | 152 | II | Rectum | 5.0 | T3 | G2 | Invasion through muscularis propria into non-peritonealized pericolic tissue; gross configuration is annular. | Neg | 0/9 | N0 | Neg | M0 | Small separate tubular adenoma (0.4 cm) |
| 141 | 160 | IV | Cecum | 5.5 | T3 | G2 | Invasion of muscularis propria into pericolonic adipose tissue, but not through serosa. Arising from tubular adenoma. | Pos | 7/21 | N2 | Pos - Liver | M1 | Perineural invasion identified adjacent to metastatic adenocarcinoma. |
| 156 | 175 | III | Hepatic flexure | 3.8 | T3 | G2 | Invasion through mucsularis propria into subserosa/pericolic adipose, no serosal involvement. Gross configuration annular. | Pos | 2/13 | N1 | Neg | M0 | Separate tubolovillous and tubular adenomas |
| 228 | 247 | III | Rectum | 5.8 | T3 | G2 to G3 | Invasion through muscularis propria to involve subserosal, perirectoal adipose, and serosa | Pos | 1/8 | N1 | Neg | MX | Hyperplastic polyps |
| 264 | 283 | II | Ascending colon | 5.5 | T3 | G2 | Invasion through muscularis propria into subserosal adipose tissue. | Neg | 0/10 | N0 | Neg | M0 | Tubulovillous adenoma with high grade dysplasia |
| 266 | 285 | III | Transverse colon | 9 | T3 | G2 | Invades through muscularis propria to involve pericolonic adipose, extends to serosa. | Neg | 0/15 | N1 | Pos - Mesenteric deposit | MX | |
| 268 | 287 | I | Cecum | 6.5 | T2 | G2 | Invades full thickness of muscularis propria, but mesenteric adipose free of malignancy | Neg | 0/12 | N0 | Neg | M0 | |
| 278 | 297 | III | Rectum | 4 | T3 | G2 | Invasion into perirectal adipose tissue. | Pos | 7/10 | N2 | Neg | M0 | Descending colon polyps, no HGD or carcinoma identified. |
| 295 | 314 | II | Ascending colon | 5.0 | T3 | G2 | Invasion through muscularis propria into percolic adipose tissue. | Neg | 0/12 | N0 | Neg | M0 | Melanosis coli and diverticular disease. |
| 296 | 315 | III | Cecum | 5.5 | T3 | G2 | Invasion through muscularis propria and invades pericolic adipose tissue. Ileocecal | Pos | 2/12 | N1 | Neg | M0 | Tubulovillous adenoma (2.0 cm) with no high grade dysplasia. |

TABLE 11-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| | | | | | | | junction. | | | | | | Neg. liver biopsy. |
| 339 | 358 | II | Recto-sigmoid | 6 | T3 | G2 | Extends into perirectal fat but does not reach serosa | Neg | 0/6 | N0 | Neg | M0 | 1 hyperplastic polyp identified |
| 341 | 360 | II | Ascending colon | 2 cm invasive | T3 | G2 | Invasion through muscularis propria to involve pericolonic fat. Arising from villous adenoma. | Neg | 0/4 | N0 | Neg | MX | |
| 356 | 375 | II | Sigmoid | 6.5 | T3 | G2 | Through colon wall into subserosal adipose tissue. No serosal spread seen. | Neg | 0/4 | N0 | Neg | M0 | |
| 392 | 444 | IV | Ascending colon | 2 | T3 | G2 | Invasion through muscularis propria into subserosal adipose tissue, not serosa. | Pos | 1/6 | N1 | Pos - Liver | M1 | Tumor arising at prior ileocolic surgical anastomosis. |
| 393 | 445 | II | Cecum | 6.0 | T3 | G2 | Cecum, invades through muscularis propria to involve subserosal adipose tissue but not serosa. | Neg | 0/21 | N0 | Neg | M0 | |
| 413 | 465 | IV | Cecum | 4.8 | T3 | G2 | Invasive through muscularis to involve periserosal fat; abutting ileocecal junction. | Neg | 0/7 | N0 | Pos - Liver | M1 | rediagnosis of oophorectomy path to metastatic colon cancer. |
| 517 | 395 | IV | Sigmoid | 3 | T3 | G2 | penetrates muscularis propria, involves pericolonic fat. | Pos | 6/6 | N2 | Neg | M0 | No mention of distant met in report |
| 546 | 565 | IV | Ascending colon | 5.5 | T3 Liver | G2 | Invasion through muscularis propria extensively through submucosal and extending to serosa. | Pos | 6/12 | N2 | Pos | M1 | |
| 577 | 596 | II | Cecum | 11.5 | T3 | G2 | Invasion through the bowel wall, into suberosal adipose. Serosal surface free of tumor. | Neg | 0/58 | N0 | Neg | M0 | Appendix dilated and fibrotic, but not involved by tumor |
| 784 | 803 | IV | Ascending colon | 3.5 | T3 | G3 | through muscularis propria into pericolic soft tissues | Pos | 5/17 | N2 | Pos - Liver | M1 | invasive poorly differentiated adenosquamous carcinoma |
| 786 | 805 | IV | Descending colon | 9.5 | T3 | G2 | through muscularis propria into pericolic fat, but not at serosal surface | Neg | 0/12 | N0 | Pos - Liver | M1 | moderately differentiated invasive adenocarcinoma |
| 791 | 810 | IV | Ascending colon | 5.8 | T3 | G3 | Through the muscularis propria into pericolic fat | Pos | 13/25 | N2 | Pos - Liver | M1 | poorly differentiated invasive colonic adenocarcinoma |
| 888 | 908 | IV | Ascending colon | 2.0 | T2 | G1 | Into muscularis propria | Pos | 3/21 | N0 | Pos - Liver | M1 | well to moderately differentiated adenocarcinomas; this patient has tumors of the ascending colon and the sigmoid colon |
| 889 | 909 | IV | Cecum | 4.8 | T3 | G2 | Through muscularis propria | Pos | 1/4 | N1 | Pos - Liver | M1 | moderately differentiated |

TABLE 11-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 890 | 910 | IV | Ascending colon | | T3 Liver | G2 | int subserosal tissue Through muscularis propria into subserosa. | Pos | 11/15 | N2 | Pos - | M1 | adenocarcinoma |

Source of Polynucleotides on Arrays

Polynucleotides for use on the arrays were obtained from both publicly available sources and from cDNA libraries generated from selected cell lines and patient tissues. Table 12 provides information about the polynucleotides on the arrays including: (1) the "SEQ ID NO" assigned to each sequence for use in the present specification; (2) the spot identification number ("Spot ID"), an internal reference that serves as a unique identifier for the spot on the array; (3) the "Clone ID" assigned to the clone from which the sequence was isolated; (4) the number of the Group ("Grp") to which the gene is assigned (see Example 11 below); and (5) the gene represented by the SEQ ID NO ("Gene").

TABLE 12

| SEQ ID NO | Spot ID | Clone ID | Grp | Gene | GBHit | GBDesc | GBScore |
|---|---|---|---|---|---|---|---|
| 322 | 33669 | RG:26148:Order7TM01:C06 | 1 | IGF2 | X07868 | Human DNA for insulin-like growth factor II (IGF-2); exon 7 and additional ORF | 2.1E−35 |
| 323 | 32956 | RG:240381:Order7TM20:G11 | 1 | IGF2 | X03427 | Homo sapiens IGF-II gene, exon 5 | 7.4E−186 |
| 324 | 17167 | RG:730402:10010:H01 | 1 | TTK | BC000633 | Homo sapiens, TTK protein kinase, clone MGC: 865 IMAGE: 3343925, mRNA, complete cds | 2.1E−38 |
| 325 | 21711 | RG:1674098:10014:H01 | 1 | MARCKS | D10522 | Homo sapiens mRNA for 80K-L protein, complete cds | 4E−148 |
| 326 | 29171 | 035JN025.C12 | 1 | FLJ22066 | AK025719 | Homo sapiens cDNA: FLJ22066 fis, clone HEP10611 | 0 |
| 327 | 30566 | RG:432087:Order7TM26:D02 | 1 | FLJ22066 | AK025719 | Homo sapiens cDNA: FLJ22066 fis, clone HEP10611 | 0 |
| 328 | 10638 | I:1644648:07B01:G04 | 1 | NQO2 | U07736 | Human quinone oxidoreductase2 (NQO2) gene, exon 7, complete cds | 1.6E−171 |
| 329 | 8491 | I:2594080:05A01:F01 | 1 | FHL3 | BC001351 | Homo sapiens, Similar to four and a half LIM domains 3, clone MGC: 8696 IMAGE: 2964682, mRNA, compl | 2.6E−34 |
| 330 | 27092 | 035Jn031.C09 | 1 | MGC: 29604 | BC019103 | Homo sapiens, clone MGC: 29604 IMAGE: 5021401, mRNA, complete cds | 1E−300 |
| 331 | 10394 | I:1450639:03B02:E09 | 1 | CETN2 | BC005334 | Homo sapiens, centrin, EF-hand protein, 2, clone MGC: 12421 IMAGE: 3961448, mRNA, complete cds | 1.1E−190 |
| 332 | 3295 | M00008083D:D06 | 1 | CGI-148 protein | AF223467 | Homo sapiens NPD008 protein (NPD008) mRNA, complete cds | 2.5E−157 |
| 333 | 30831 | RG:301734:Order7TM22:H02 | 1 | KIP2 | AB012955 | Homo sapiens mRNA for KIP2, complete cds | 5.8E−252 |
| 334 | 19871 | RG:196236:10006:H11 | 1 | FGFR4 | AF359246 | Homo sapiens fibroblast growth factor receptor 4 variant mRNA, complete cds | 5E−249 |

TABLE 12-continued

| SEQ ID NO | Spot ID | Clone ID | Grp | Gene | GBHit | GBDesc | GBScore |
|---|---|---|---|---|---|---|---|
| 335 | 30858 | RG:359021:Order7TM24:F02 | 1 | BBS2 | AF342736 | Homo sapiens BBS2 (BBS2) mRNA, complete cds | 1E−100 |
| 336 | 17168 | RG:1320327:10012:H01 | 1 | OGG1 | Y11731 | H. sapiens mRNA for DNA glycosylase | 1E−300 |
| 337 | 17487 | RG:341475:10008:H01 | 1 | MAPKAPK2 | NM_032960 | Homo sapiens mitogen-activated protein kinase-activated protein kinase 2 (MAPKAPK2), transcript variant | 1E−300 |
| 338 | 18942 | RG:1895716:10015:G09 | 2 | ITAK | AC007055 | AC007055 Homo sapiens chromosome 14 clone BAC 201F1 map 14q24.3, complete sequence | 3.00E−94 |
| 339 | 17365 | I:504786:14A02:C07 | 2 | 1-8U; 1-8D; 9-27 | BC006794 | Homo sapiens, Similar to interferon induced transmembrane protein 3 (1-8U), clone MGC: 5225 IMAGE: | 6.4E−295 |
| 340 | 21144 | M00055353D:A04 | 2 | 1-8U; 1-8D; 9-27 | BC006794 | Homo sapiens, Similar to interferon induced transmembrane protein 3 (1-8U), clone MGC: 5225 IMAGE: | 1.1E−156 |
| 341 | 11573 | I:1513214:04A01:C11 | 2 | BIRC3 | U45878 | Human inhibitor of apoptosis protein 1 mRNA, complete cds | 2.5E−157 |

The sequences corresponding to the SEQ ID NOS are provided in the Sequence Listing.

Characterization of Sequences

The sequences of the isolated polynucleotides were first masked to eliminate low complexity sequences using the RepeatMasker masking program, publicly available through a web site supported by the University of Washington (See also Smit, A. F. A. and Green, P., unpublished results). Generally, masking does not influence the final search results, except to eliminate sequences of relatively little interest due to their low complexity, and to eliminate multiple "hits" based on similarity to repetitive regions common to multiple sequences, e.g., Alu repeats. Masking resulted in the elimination of several sequences.

The remaining sequences of the isolated polynucleotides were used in a homology search of the GenBank database using the TeraBLAST program (TimeLogic, Crystal Bay, Nev.), a DNA and protein sequence homology searching algorithm. TeraBLAST is a version of the publicly available BLAST search algorithm developed by the National Center for Biotechnology, modified to operate at an accelerated speed with increased sensitivity on a specialized computer hardware platform. The program was run with the default parameters recommended by TimeLogic to provide the best sensitivity and speed for searching DNA and protein sequences. Gene assignment for the query sequences was determined based on best hit form the GenBank database; expectancy values are provided with the hit.

Summary of TeraBLAST Search Results

Table 12 also provides information about the gene corresponding to each polynucleotide. Table 12 includes: (1) the "SEQ ID NO" of the sequence; (2) the GenBank Accession Number of the publicly available sequence corresponding to the polynucleotide ("GBHit"); (3) a description of the GenBank sequence ("GBDesc"); (4) the score of the similarity of the polynucleotide sequence and the GenBank sequence ("GBScore"). The published information for each GenBank and EST description, as well as the corresponding sequence identified by the provided accession number, are incorporated herein by reference.

Example 10

Detection of Differential Expression Using Arrays cDNA probes were prepared from total RNA isolated from the patient cells described above. Since LCM provides for the isolation of specific cell types to provide a substantially homogenous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) Nature Med 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from normal cell RNA sample. For example, the cDNA probes from the normal cells were labeled with Cy3 fluorescent dye (green) and the cDNA probes prepared from the tumor cells were labeled with Cy5 fluorescent dye (red), and vice versa.

Each array used had an identical spatial layout and control spot set. Each microarray was divided into two areas, each area having an array with, on each half, twelve groupings of 32×12 spots, for a total of about 9,216 spots on each array. The two areas are spotted identically which provide for at least two duplicates of each clone per array.

Polynucleotides for use on the arrays were obtained from both publicly available sources and from cDNA libraries generated from selected cell lines and patient tissues as described above and in Table 12. PCR products of from about 0.5 kb to 2.0 kb amplified from these sources were spotted onto the array using a Molecular Dynamics Gen III spotter according to the manufacturer's recommendations. The first row of each of the 24 regions on the array had about 32 control spots, including 4 negative control spots and 8 test polynucleotides. The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about four duplicate measurements for each clone, two of one color and two of the other, for each sample.

The differential expression assay was performed by mixing equal amounts of probes from tumor cells and normal cells of the same patient. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction).

The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p > 10^{-3}$, and the differential ratio was set to 1.000 for those spots. All other spots have a significant difference in expression between the tumor and normal sample. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level ($p > 0.05$).

Tables 13A-D summarize the results of the differential expression analysis. Table 13 provides: (1) the spot identification number ("Spot ID"), an internal reference that serves as a unique identifier for the spot on the array; (2) the number of the Group ("Grp") to which the gene is assigned (see Example 11 below); and (3) the ratio of expression of the gene in each of the patient samples, identified by the patient ID number (e.g., 15). This data represents the ratio of differential expression for the samples tested from that particular patient's tissues (e.g., "RATIO15" is the ratio from the tissue samples of Patient ID no. 15). The ratios of differential expression are expressed as a normalized hybridization signal associated with the tumor probe divided by the normalized hybridization signal with the normal probe. Thus, a ratio greater than 1 indicates that the gene product is increased in expression in cancerous cells relative to normal cells, while a ratio of less than 1 indicates the opposite.

TABLE 13A

| Spot ID | Grp | Gene | RATIO 015 | RATIO 052 | RATIO 121 | RATIO 125 | RATIO 128 | RATIO 130 | RATIO 133 | RATIO 141 | RATIO 156 |
|---|---|---|---|---|---|---|---|---|---|---|---|
| 3295 | 1 | CGI-148 protein | 0.603 | 0.569 | 1.420 | 1.000 | 1.347 | 0.544 | 1.000 | 0.663 | 0.400 |
| 8491 | 1 | FHL3 | 1.000 | 1.000 | 10.786 | 6.347 | 4.580 | 2.918 | 5.331 | 1.000 | 2.771 |
| 10394 | 1 | CETN2 | 1.000 | 1.000 | 3.335 | 1.000 | 2.493 | 2.450 | 1.000 | 1.000 | 2.130 |
| 10638 | 1 | NQO2 | 1.000 | 1.000 | 2.522 | 1.720 | 2.495 | 1.000 | 1.748 | 1.000 | 2.018 |
| 17167 | 1 | TTK | 1.000 | 1.000 | 5.053 | 1.000 | 5.484 | 1.000 | 1.000 | 1.000 | 1.000 |
| 17168 | 1 | OGG1 | 1.389 | 1.000 | 1.736 | 1.000 | 2.525 | 1.000 | 2.339 | 1.000 | 1.162 |
| 17487 | 1 | MAPKAPK2 | 1.000 | 1.000 | 39.041 | 1.000 | 26.551 | 1.000 | 54.030 | 0.657 | 0.116 |
| 19871 | 1 | FGFR4 | 1.000 | 1.000 | 4.040 | 0.760 | 3.246 | 1.000 | 4.017 | 1.859 | 0.224 |
| 21711 | 1 | MARCKS | 1.000 | 1.000 | 21.440 | 1.294 | 10.369 | 1.000 | 20.040 | 1.000 | 1.000 |
| 27092 | 1 | MGC:29604 | 1.806 | 2.418 | 5.831 | 2.114 | 11.273 | 1.821 | 9.841 | 1.413 | 2.385 |
| 29171 | 1 | FLJ22066 | 1.000 | 1.000 | 184.016 | 0.728 | 52.758 | 0.849 | 145.030 | 1.000 | 0.015 |
| 30566 | 1 | FLJ22066 | 1.000 | 1.000 | 163.068 | 1.000 | 53.616 | 1.000 | 1.000 | 1.000 | 0.083 |
| 30831 | 1 | KIP2 | 0.723 | 1.000 | 2.349 | 1.000 | 1.972 | 1.000 | 1.000 | 1.437 | 0.626 |
| 30858 | 1 | BBS2 | 1.304 | 0.745 | 1.907 | 1.678 | 2.686 | 0.525 | 1.877 | 1.000 | 0.251 |

TABLE 13A-continued

| Spot ID | Grp | Gene | RATIO 015 | RATIO 052 | RATIO 121 | RATIO 125 | RATIO 128 | RATIO 130 | RATIO 133 | RATIO 141 | RATIO 156 |
|---|---|---|---|---|---|---|---|---|---|---|---|
| 32956 | 1 | IGF2 | 1.105 | 1.000 | 20.747 | 1.000 | 10.458 | 1.000 | 1.000 | 1.000 | 0.476 |
| 33669 | 1 | IGF2 | 0.592 | 0.381 | 21.028 | 1.195 | 16.876 | 0.334 | 25.468 | 0.720 | 0.049 |
| 11573 | 2 | BIRC3 | 1.698 | 2.791 | 0.825 | 1.319 | 1.264 | 1.587 | 1.986 | 0.408 | 1.504 |
| 17365 | 2 | 1-8U; 1-8D; 9-27 | 3.113 | 2.893 | 1.229 | 4.848 | 3.307 | 4.004 | 9.166 | 1.000 | 1.769 |
| 18942 | 2 | ITAK | 4.489 | 7.386 | 1.000 | 6.655 | 4.507 | 5.485 | 12.390 | 1.000 | 2.281 |
| 21144 | 2 | 1-8U; 1-8D; 9-27 | 5.520 | 22.946 | 1.000 | 5.929 | 3.918 | 7.337 | 8.908 | 1.182 | 1.706 |

TABLE 13B

| Spot ID | Grp | Gene | RATIO 228 | RATIO 264 | RATIO 266 | RATIO 268 | RATIO 278 | RATIO 295 | RATIO 296 | RATIO 339 | RATIO 341 |
|---|---|---|---|---|---|---|---|---|---|---|---|
| 3295 | 1 | CGI-148 protein | 0.579 | 0.599 | 0.302 | 1.000 | 1.270 | 1.000 | 0.484 | 0.561 | 1.000 |
| 8491 | 1 | FHL3 | 1.000 | 1.000 | 1.000 | 12.583 | 4.691 | 1000.000 | 1000.000 | 3.136 | 7.320 |
| 10394 | 1 | CETN2 | 1.000 | 1.000 | 1.000 | 3.463 | 1.000 | 1.000 | 1000.000 | 1.000 | 4.065 |
| 10638 | 1 | 9 | 1.000 | 1.000 | 1.000 | 3.325 | 1.697 | 1.000 | 1000.000 | 1.000 | 3.036 |
| 17167 | 1 | TTK | 1.000 | 1.724 | 1.515 | 1.000 | 1.000 | 1.000 | 1000.000 | 1.000 | 5.355 |
| 17168 | 1 | OGG1 | 1.000 | 1.584 | 1.332 | 2.564 | 2.024 | 1.600 | 1.551 | 0.739 | 1.999 |
| 17487 | 1 | MAPKAPK2 | 1.000 | 1.000 | 1.206 | 43.580 | 23.642 | 2.085 | 1.000 | 0.545 | 18.309 |
| 19871 | 1 | FGFR4 | 1.619 | 1.992 | 1.000 | 4.407 | 3.989 | 1000.000 | 1.000 | 1.324 | 2.494 |
| 21711 | 1 | MARCKS | 1.000 | 1.000 | 1.192 | 13.283 | 1.000 | 2.161 | 1.000 | 0.638 | 1.000 |
| 27092 | 1 | MGC:29604 | 1.927 | 3.330 | 2.678 | 10.984 | 9.190 | 4.226 | 8.035 | 0.757 | 14.757 |
| 29171 | 1 | FLJ22066 | 1.000 | 1.760 | 1.000 | 186.617 | 83.660 | 4.242 | 1000.000 | 0.303 | 102.601 |
| 30566 | 1 | FLJ22066 | 1.596 | 1.430 | 1.000 | 108.781 | 51.686 | 1.000 | 1.000 | 0.530 | 50.061 |
| 30831 | 1 | KIP2 | 0.672 | 0.952 | 1.000 | 1.000 | 2.848 | 1.000 | 1.000 | 1.000 | 2.521 |
| 30858 | 1 | BBS2 | 1.393 | 1.547 | 1.431 | 2.272 | 1.440 | 1.000 | 1.000 | 1.000 | 2.180 |
| 32956 | 1 | IGF2 | 1.000 | 1.000 | 1.000 | 32.991 | 3.788 | 1.000 | 1.000 | 1.565 | 10.202 |
| 33669 | 1 | IGF2 | 0.566 | 0.380 | 0.196 | 14.331 | 4.654 | 0.298 | 0.237 | 0.508 | 11.442 |
| 11573 | 2 | BIRC3 | 1.000 | 1.645 | 1.000 | 1.283 | 1.667 | 1.408 | 2.084 | 1.000 | 1.000 |
| 17365 | 2 | 1-8U; 1-8D; 9-27 | 2.633 | 7.263 | 7.775 | 4.152 | 4.770 | 3.064 | 2.220 | 1.374 | 1.808 |
| 18942 | 2 | ITAK | 4.106 | 10.286 | 11.733 | 6.840 | 1.000 | 11.385 | 1.000 | 1.892 | 1.690 |
| 21144 | 2 | 1-8U; 1-8D; 9-27 | 5.027 | 8.086 | 8.148 | 3.902 | 7.228 | 5.159 | 1.000 | 2.787 | 1.569 |

TABLE 13C

| Spot ID | Grp | Gene | RATIO 356 | RATIO 392 | RATIO 393 | RATIO 413 | RATIO 517 | RATIO 546 | RATIO 577 | RATIO 784 | RATIO 786 |
|---|---|---|---|---|---|---|---|---|---|---|---|
| 3295 | 1 | CGI-148 protein | 0.503 | 0.816 | 0.692 | 0.649 | 0.200 | 1.000 | 1.000 | 0.662 | 0.532 |
| 8491 | 1 | FHL3 | 1.000 | 1.000 | 13.185 | 1.000 | 1000.000 | 3.131 | 5.278 | 1.000 | 1.000 |
| 10394 | 1 | CETN2 | 1000.000 | 1.000 | 3.015 | 1.000 | 1.000 | 1.000 | 1.000 | 1.000 | 1.000 |
| 10638 | 1 | NQO2 | 1.000 | 1.000 | 2.850 | 1.000 | 1.000 | 1.000 | 1.000 | 1.000 | 1.000 |
| 17167 | 1 | TTK | 1.000 | 1.000 | 5.355 | 1.000 | 1.000 | 1.000 | 3.158 | 1.092 | 1.898 |
| 17168 | 1 | OGG1 | 1.000 | 2.116 | 1.694 | 1.000 | 1.000 | 1.000 | 1.672 | 1.701 | 1.000 |
| 17487 | 1 | MAPKAPK2 | 1.556 | 51.316 | 43.253 | 0.516 | 1.412 | 0.813 | 1.000 | 1.000 | 1.000 |
| 19871 | 1 | FGFR4 | 1.000 | 2.284 | 4.041 | 1.000 | 3.005 | 2.185 | 1.000 | 1.000 | 3.307 |
| 21711 | 1 | MARCKS | 1.000 | 32.171 | 26.574 | 0.814 | 1.000 | 1.000 | 1.347 | 1.000 | 1.000 |
| 27092 | 1 | MGC:29604 | 7.284 | 12.948 | 8.685 | 1.742 | 1.451 | 2.296 | 3.357 | 1.329 | 2.919 |
| 29171 | 1 | FLJ22066 | 1.000 | 218.198 | 197.610 | 0.330 | 1.657 | 0.749 | 1.000 | 1.000 | 1.790 |
| 30566 | 1 | FLJ22066 | 1.000 | 264.417 | 157.238 | 0.293 | 1.300 | 1.000 | 1.220 | 2.785 | 1.000 |
| 30831 | 1 | KIP2 | 1.000 | 1.997 | 1.964 | 1.000 | 1.379 | 1.119 | 0.753 | 1.972 | 1.000 |
| 30858 | 1 | BBS2 | 0.519 | 3.152 | 2.475 | 3.013 | 0.449 | 1.000 | 0.662 | 1.339 | 1.000 |
| 32956 | 1 | IGF2 | 1.475 | 25.053 | 23.953 | 1.000 | 1.529 | 1.430 | 1.600 | 1.430 | 1.713 |
| 33669 | 1 | IGF2 | 0.412 | 24.283 | 30.632 | 0.564 | 0.214 | 0.853 | 0.381 | 0.551 | 0.506 |
| 11573 | 2 | BIRC3 | 1.000 | 1.199 | 1.768 | 1.000 | 1.485 | 1.000 | 1.429 | 1.000 | 1.648 |
| 17365 | 2 | 1-8U; 1-8D; 9-27 | 3.636 | 9.985 | 7.293 | 2.980 | 4.484 | 3.107 | 4.362 | 1.645 | 4.670 |
| 18942 | 2 | ITAK | 12.611 | 16.163 | 7.279 | 3.603 | 6.904 | 4.196 | 7.792 | 1.000 | 8.475 |
| 21144 | 2 | 1-8U; 1-8D; 9-27 | 10.080 | 18.239 | 8.395 | 2.839 | 6.176 | 3.328 | 5.636 | 2.142 | 7.000 |

TABLE 13D

| Spot ID | Grp | Gene | RATIO 791 | RATIO 888 | RATIO 889 | RATIO 890 |
|---|---|---|---|---|---|---|
| 3295 | 1 | CGI-148 protein | 0.495 | 0.574 | 0.483 | 0.711 |
| 8491 | 1 | FHL3 | 1.000 | 1.000 | 1.000 | 5.465 |
| 10394 | 1 | CETN2 | 1.000 | 2.970 | 1.000 | 2.848 |
| 10638 | 1 | NQO2 | 1.000 | 1.511 | 1.000 | 2.158 |
| 17167 | 1 | TTK | 1.000 | 1.000 | 1.000 | 2.290 |
| 17168 | 1 | OGG1 | 1.000 | 1.000 | 1.000 | 1.519 |
| 17487 | 1 | MAPKAPK2 | 1.000 | 1.449 | 1.000 | 1.516 |
| 19871 | 1 | FGFR4 | 1.000 | 1.988 | 0.646 | 4.007 |
| 21711 | 1 | MARCKS | 1.000 | 1.397 | 1.000 | 1.000 |
| 27092 | 1 | MGC:29604 | 3.771 | 1.890 | 2.788 | 1.799 |
| 29171 | 1 | FLJ22066 | 1.000 | 1.000 | 7.569 | 2.512 |
| 30566 | 1 | FLJ22066 | 1.000 | 2.624 | 1.000 | 1.713 |
| 30831 | 1 | KIP2 | 1.000 | 1.000 | 1.000 | 4.213 |
| 30858 | 1 | BBS2 | 0.749 | 2.316 | 0.506 | 1.000 |
| 32956 | 1 | IGF2 | 1.486 | 1.633 | 1.000 | 1.491 |
| 33669 | 1 | IGF2 | 0.474 | 0.842 | 2.502 | 0.736 |
| 11573 | 2 | BIRC3 | 2.502 | 0.781 | 1.314 | 1.000 |
| 17365 | 2 | 1-8U; 1-8D; 9-27 | 8.576 | 2.723 | 3.553 | 11.697 |
| 18942 | 2 | ITAK | 10.189 | 2.909 | 4.165 | 11.972 |
| 21144 | 2 | 1-8U; 1-8D; 9-27 | 14.444 | 2.712 | 7.659 | 11.467 |

These data provide evidence that the genes represented by the polynucleotides having the indicated sequences are differentially expressed in colon cancer as compared to normal non-cancerous colon tissue.

Example 11

Stratification of Colon Cancers Using Differential Expression Data

Groups of genes with differential expression data correlating with specific genes of interest can be identified using statistical analysis such as the Student t-test and Spearman rank correlation (Stanton Glantz (1997) Primer of Bio-Statistics, McGraw Hill, pp 65-107, 256-262). Using these statistical tests, patients having tumors that exhibit similar differential expression patterns can be assigned to Groups. At least two Groups were identified, and are described below.

Group 1

Genes that Exhibit Differential Expression in Colon Cancer in a Pattern that Correlates with IGF2

Using both the Student-t test and the Spearman rank correlation test, the differential expression data of IGF2 correlated with that of 14 distinct genes: TTK, MAPKAPK2, MARCKS, BBS2, CETN2 CGI-148 protein, FGFR4, FHL3, FLJ22066, KIP2, MGC:29604, NQO2, and OGG1 (see Tables 13A-D). The differential expression data for these genes is presented in graphical form in FIGS. 2-17. This group was identified as Group 1. IGF2 is a secreted protein and has been reported to be involved in colon as well as other cancers (Toretsky J A and Helman L J (1996) J Endocrinol 149(3):367-72). Genes whose expression patterns correlate with IGF2 may provide a mechanism for the involvement of IGF2 in cancer. Among the genes in Group 1 are genes such as TTK (a kinase implicated in mitotic spindle check point), MAP-KAP kinase 2 (mitogen-activated protein (MAP) kinase activated protein kinase 2), and MARCKS (myristoylated alanine-rich C kinase substrate, which is a substrate of protein kinase C). The protein products of these genes and their associated signaling pathways can be targets for small molecule drug development for anti-cancer therapy. Furthermore, the upregulation of IGF2 can be a criterion for selecting patients who will benefit from anti-cancer therapy targeted to the genes in Group 1 and their associated pathway components.

Group 2

Genes that Exhibit Differential Expression in Colon Cancer in a Pattern that Correlates Interferon Induced Transmembrane (IFITM) Protein Family Using the Spearman rank correlation test, the differential expression data of the IFITM family (1-8U; 1-8D; 9-27) correlated with that of 2 other genes: ITAK and BIRC3/H-IAP1 (see Tables 13A-D). The differential expression data for these genes is presented in graphical form in FIGS. 18-21. This group was identified as Group 2. 1-8U/IFITM3 was previously reported as a gene differentially upregulated in ulcerative-colitis-associated colon cancer (Hisamatsu et al (1999) Cancer Research 59, 5927-5931). Genes whose expression patterns correlate with 1-8U/IFITM3 and its family members may provide a mechanism for the involvement of inflammation in colon cancer. There are at least 3 members of the IFITM family: 9-27/IFITM1, 1-8D/IFITM2 and 1-8U/IFITM3. The polynucleotides used for the detection of 1-8U/IFITM3 are within a domain that is highly conserved among the 3 members. Therefore, the upregulation detected by the corresponding microarray spots may indicate the upregulation of one or multiple members within the family. Among the genes in Group 2 are ITAK (IL-1, TNF alpha activated kinase) and BIRC3/H-IAP1 (human inhibitor of apoptosis 1). The protein products of these genes and their associated signaling pathways can be targets for small molecule drug development for anti-cancer therapy. Furthermore, the upregulation of the IFITM can be a criterion for selecting patients who will benefit from anti-cancer therapy targeted to the genes in Group 2 and their associated pathway components.

Example 12

Antisense Regulation of Gene Expression

The expression of the differentially expressed genes represented by the polynucleotides in the cancerous cells can be analyzed using antisense knockout technology to confirm the role and function of the gene product in tumorigenesis, e.g., in promoting a metastatic phenotype.

A number of different oligonucleotides complementary to the mRNA generated by the differentially expressed genes identified herein can be designed as potential antisense oligonucleotides, and tested for their ability to suppress expression of the genes. Sets of antisense oligomers specific to each candidate target are designed using the sequences of the polynucleotides corresponding to a differentially expressed gene and the software program HYBsimulator Version 4 (available for Windows 95/Windows NT or for Power Macintosh, RNAture, Inc. 1003 Health Sciences Road, West, Irvine, Calif. 92612 USA). Factors that are considered when designing antisense oligonucleotides include: 1) the secondary structure of oligonucleotides; 2) the secondary structure of the target gene; 3) the specificity with no or minimum cross-hybridization to other expressed genes; 4) stability; 5) length and 6) terminal GC content. The antisense oligonucleotide is designed so that it will hybridize to its target sequence under conditions of high stringency at physiological temperatures (e.g., an optimal temperature for the cells in culture to provide for hybridization in the cell, e.g., about 37° C.), but with minimal formation of homodimers.

Using the sets of oligomers and the HYBsimulator program, three to ten antisense oligonucleotides and their reverse controls are designed and synthesized for each candidate mRNA transcript, which transcript is obtained from the gene corresponding to the target polynucleotide sequence of interest. Once synthesized and quantitated, the oligomers are screened for efficiency of a transcript knock-out in a panel of cancer cell lines. The efficiency of the knock-out is determined by analyzing mRNA levels using lightcycler quantification. The oligomers that resulted in the highest level of transcript knock-out, wherein the level was at least about 50%, preferably about 80-90%, up to 95% or more up to undetectable message, are selected for use in a cell-based proliferation assay, an anchorage independent growth assay, and an apoptosis assay.

The ability of each designed antisense oligonucleotide to inhibit gene expression is tested through transfection into SW620 colon carcinoma cells. For each transfection mixture, a carrier molecule (such as a lipid, lipid derivative, lipid-like molecule, cholesterol, cholesterol derivative, or cholesterol-like molecule) is prepared to a working concentration of 0.5 mM in water, sonicated to yield a uniform solution, and filtered through a 0.45 μm PVDF membrane. The antisense or control oligonucleotide is then prepared to a working concentration of 100 μM in sterile Millipore water. The oligonucleotide is further diluted in OptiMEM™ (Gibco/BRL), in a microfuge tube, to 2 μM, or approximately 20 μg oligo/ml of OptiMEM™. In a separate microfuge tube, the carrier molecule, typically in the amount of about 1.5-2 nmol carrier/μg antisense oligonucleotide, is diluted into the same volume of OptiMEM™ used to dilute the oligonucleotide. The diluted antisense oligonucleotide is immediately added to the diluted carrier and mixed by pipetting up and down. Oligonucleotide is added to the cells to a final concentration of 30 nM.

The level of target mRNA that corresponds to a target gene of interest in the transfected cells is quantitated in the cancer cell lines using the Roche LightCycler™ real-time PCR machine. Values for the target mRNA are normalized versus an internal control (e.g., beta-actin). For each 20 μl reaction, extracted RNA (generally 0.2-1 μg total) is placed into a sterile 0.5 or 1.5 ml microcentrifuge tube, and water is added to a total volume of 12.5 μl. To each tube is added 7.5 μl of a buffer/enzyme mixture, prepared by mixing (in the order listed) 2.5 μl $H_2O$, 2.0 μl 10× reaction buffer, 10 μl oligo dT (20 pmol), 1.0 μl dNTP mix (10 mM each), 0.5 μl RNAsin® (20 u) (Ambion, Inc., Hialeah, Fla.), and 0.5 μl MMLV reverse transcriptase (50 u) (Ambion, Inc.). The contents are mixed by pipetting up and down, and the reaction mixture is incubated at 42° C. for 1 hour. The contents of each tube are centrifuged prior to amplification.

An amplification mixture is prepared by mixing in the following order: 1×PCR buffer II, 3 mM $MgCl_2$, 140 μM each dNTP, 0.175 pmol each oligo, 1:50,000 dil of SYBR® Green, 0.25 mg/ml BSA, 1 unit Taq polymerase, and $H_2O$ to 20 μl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 μl aliquot of amplification mixture, 2 μl of template RT is added, and amplification is carried out according to standard protocols. The results are expressed as the percent decrease in expression of the corresponding gene product relative to non-transfected cells, vehicle-only transfected (mock-transfected) cells, or cells transfected with reverse control oligonucleotides.

Example 13

Effect of Expression on Proliferation

The effect of gene expression on the inhibition of cell proliferation can be assessed in metastatic breast cancer cell lines (MDA-MB-231 ("231")); SW620 colon colorectal carcinoma cells; SKOV3 cells (a human ovarian carcinoma cell line); or LNCaP, PC3, 22Rv1, MDA-PCA-2b, or DU145 prostate cancer cells.

Cells are plated to approximately 60-80% confluency in 96-well dishes. Antisense or reverse control oligonucleotide is diluted to 2 μM in OptiMEM™. The oligonucleotide-OptiMEM™ can then be added to a delivery vehicle, which delivery vehicle can be selected so as to be optimized for the particular cell type to be used in the assay. The oligo/delivery vehicle mixture is then further diluted into medium with serum on the cells. The final concentration of oligonucleotide for all experiments can be about 300 nM.

Antisense oligonucleotides are prepared as described above (see Example 12). Cells are transfected overnight at 37° C. and the transfection mixture is replaced with fresh medium the next morning. Transfection is carried out as described above in Example 12.

Those antisense oligonucleotides that result in inhibition of proliferation of SW620 cells indicate that the corresponding gene plays a role in production or maintenance of the cancerous phenotype in cancerous colon cells. Those antisense oligonucleotides that inhibit proliferation in SKOV3 cells represent genes that play a role in production or maintenance of the cancerous phenotype in cancerous breast cells. Those antisense oligonucleotides that result in inhibition of proliferation of MDA-MB-231 cells indicate that the corresponding gene plays a role in production or maintenance of the cancerous phenotype in cancerous ovarian cells. Those antisense oligonucleotides that inhibit proliferation in LNCaP, PC3, 22Rv1, MDA-PCA-2b, or DU145 cells represent genes that play a role in production or maintenance of the cancerous phenotype in cancerous prostate cells.

Example 14

Effect of Gene Expression on Cell Migration

The effect of gene expression on the inhibition of cell migration can be assessed in SW620 colon cancer cells using static endothelial cell binding assays, non-static endothelial cell binding assays, and transmigration assays.

For the static endothelial cell binding assay, antisense oligonucleotides are prepared as described above (see Example 12). Two days prior to use, colon cancer cells (CaP) are plated and transfected with antisense oligonucleotide as described above (see Examples 4 and 5). On the day before use, the medium is replaced with fresh medium, and on the day of use, the medium is replaced with fresh medium containing 2 μM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in DMEM/1% BSA/10 mM HEPES pH 7.0. Finally, CaP cells are counted and resuspended at a concentration of $1 \times 10^6$ cells/ml.

Endothelial cells (EC) are plated onto 96-well plates at 40-50% confluence 3 days prior to use. On the day of use, EC are washed 1× with PBS and 50λ DMDM/1% BSA/10 mM HEPES pH 7 is added to each well. To each well is then added 50K (50□) CaP cells in DMEM/1% BSA/10 mM HEPES pH 7. The plates are incubated for an additional 30 min and washed 5× with PBS containing $Ca^{++}$ and $Mg^{++}$. After the final wash, 100 μL PBS is added to each well and fluorescence is read on a fluorescent plate reader (Ab492/Em 516 nm).

For the non-static endothelial cell binding assay, CaP are prepared as described above. EC are plated onto 24-well plates at 30-40% confluence 3 days prior to use. On the day of use, a subset of EC are treated with cytokine for 6 hours then washed 2× with PBS. To each well is then added 150-200K CaP cells in DMEM/1% BSA/10 mM HEPES pH 7. Plates are placed on a rotating shaker (70 RPM) for 30 min and then washed 3× with PBS containing $Ca^{++}$ and $Mg^{++}$. After the final wash, 500 μL PBS is added to each well and fluorescence is read on a fluorescent plate reader (Ab492/Em 516 nm).

For the transmigration assay, CaP are prepared as described above with the following changes. On the day of use, CaP medium is replaced with fresh medium containing 5 μM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in EGM-2-MV medium. Finally, CaP cells are counted and resuspended at a concentration of $1\times10^6$ cells/ml.

EC are plated onto FluorBlok transwells (BD Biosciences) at 30-40% confluence 5-7 days before use. Medium is replaced with fresh medium 3 days before use and on the day of use. To each transwell is then added 50K labeled CaP. 30 min prior to the first fluorescence reading, 10 μg of FITC-dextran (10K MW) is added to the EC plated filter. Fluorescence is then read at multiple time points on a fluorescent plate reader (Ab492/Em 516 nm).

Those antisense oligonucleotides that result in inhibition of binding of SW620 colon cancer cells to endothelial cells indicate that the corresponding gene plays a role in the production or maintenance of the cancerous phenotype in cancerous colon cells. Those antisense oligonucleotides that result in inhibition of endothelial cell transmigration by SW620 colon cancer cells indicate that the corresponding gene plays a role in the production or maintenance of the cancerous phenotype in cancerous colon cells.

Example 15

Effect of Gene Expression on Colony Formation

The effect of gene expression upon colony formation of SW620 cells, SKOV3 cells, MD-MBA-231 cells, LNCaP cells, PC3 cells, 22Rv1 cells, MDA-PCA-2b cells, and DU145 cells can be tested in a soft agar assay. Soft agar assays are conducted by first establishing a bottom layer of 2 ml of 0.6% agar in media plated fresh within a few hours of layering on the cells. The cell layer is formed on the bottom layer by removing cells transfected as described above from plates using 0.05% trypsin and washing twice in media. The cells are counted in a Coulter counter, and resuspended to $10^6$ per ml in media. 10 μl aliquots are placed with media in 96-well plates (to check counting with WST1), or diluted further for the soft agar assay. 2000 cells are plated in 800 μl 0.4% agar in duplicate wells above 0.6% agar bottom layer. After the cell layer agar solidifies, 2 ml of media is dribbled on top and antisense or reverse control oligo (produced as described in Example 12) is added without delivery vehicles. Fresh media and oligos are added every 3-4 days. Colonies form in 10 days to 3 weeks. Fields of colonies are counted by eye. Wst-1 metabolism values can be used to compensate for small differences in starting cell number. Larger fields can be scanned for visual record of differences.

Those antisense oligonucleotides that result in inhibition of colony formation of SW620 cells indicate that the corresponding gene plays a role in production or maintenance of the cancerous phenotype in cancerous colon cells. Those antisense oligonucleotides that inhibit colony formation in SKOV3 cells represent genes that play a role in production or maintenance of the cancerous phenotype in cancerous breast cells. Those antisense oligonucleotides that result in inhibition of colony formation of MDA-MB-231 cells indicate that the corresponding gene plays a role in production or maintenance of the cancerous phenotype in cancerous ovarian cells. Those antisense oligonucleotides that inhibit colony formation in LNCaP, PC3, 22Rv1, MDA-PCA-2b, or DU145 cells represent genes that play a role in production or maintenance of the cancerous phenotype in cancerous prostate cells.

Example 16

Induction of Cell Death Upon Depletion of Polypeptides by Depletion of mRNA ("Antisense Knockout")

In order to assess the effect of depletion of a target message upon cell death, SW620 cells, or other cells derived from a cancer of interest, can be transfected for proliferation assays. For cytotoxic effect in the presence of cisplatin (cis), the same protocol is followed but cells are left in the presence of 2 μM drug. Each day, cytotoxicity is monitored by measuring the amount of LDH enzyme released in the medium due to membrane damage. The activity of LDH is measured using the Cytotoxicity Detection Kit from Roche Molecular Biochemicals. The data is provided as a ratio of LDH released in the medium vs. the total LDH present in the well at the same time point and treatment (rLDH/tLDH). A positive control using antisense and reverse control oligonucleotides for BCL2 (a known anti-apoptotic gene) is included; loss of message for BCL2 leads to an increase in cell death compared with treatment with the control oligonucleotide (background cytotoxicity due to transfection).

Example 17

Functional Analysis Gene Products Differentially Expressed in Colon Cancer Patients The gene products of sequences of a gene differentially expressed in cancerous cells can be further analyzed to confirm the role and function of the gene product in tumorigenesis, e.g., in promoting or inhibiting development of a metastatic phenotype. For example, the function of gene products corresponding to genes identified herein can be assessed by blocking function of the gene products in the cell. For example, where the gene product is secreted or associated with a cell surface membrane, blocking antibodies can be generated and added to cells to examine the effect upon the cell phenotype in the context of, for example, the transformation of the cell to a cancerous, particularly a metastatic, phenotype. In order to generate antibodies, a clone corresponding to a selected gene product is selected, and a sequence that represents a partial or complete coding sequence is obtained.

The resulting clone is expressed, the polypeptide produced isolated, and antibodies generated. The antibodies are then combined with cells and the effect upon tumorigenesis assessed.

Where the gene product of the differentially expressed genes identified herein exhibits sequence homology to a protein of known function (e.g., to a specific kinase or protease) and/or to a protein family of known function (e.g., contains a domain or other consensus sequence present in a protease family or in a kinase family), then the role of the gene product in tumorigenesis, as well as the activity of the gene product, can be examined using small molecules that inhibit or enhance function of the corresponding protein or protein family.

Additional functional assays include, but are not necessarily limited to, those that analyze the effect of expression of the corresponding gene upon cell cycle and cell migration. Methods for performing such assays are well known in the art.

Example 18

Contig Assembly and Additional Gene Characterization

The sequences of the polynucleotides provided in the present invention can be used to extend the sequence information of the gene to which the polynucleotides correspond (e.g., a gene, or mRNA encoded by the gene, having a sequence of the polynucleotide described herein). This expanded sequence information can in turn be used to further characterize the corresponding gene, which in turn provides additional information about the nature of the gene product (e.g., the normal function of the gene product). The additional information can serve to provide additional evidence of the gene product's use as a therapeutic target, and provide further guidance as to the types of agents that can modulate its activity.

In one example, a contig is assembled using a sequence of a polynucleotide of the present invention, which is present in a clone. A "contig" is a contiguous sequence of nucleotides that is assembled from nucleic acid sequences having overlapping (e.g., shared or substantially similar) sequence information. The sequences of publicly-available ESTs (Expressed Sequence Tags) and the sequences of various clones from several cDNA libraries synthesized at Chiron can be used in the contig assembly.

The contig is assembled using the software program Sequencher, version 4.05, according to the manufacturer's instructions and an overview alignment of the contiged sequences is produced. The sequence information obtained in the contig assembly can then be used to obtain a consensus sequence derived from the contig using the Sequencher program. The consensus sequence is used as a query sequence in a TeraBLASTN search of the DGTI DoubleTwist-Gene Index (DoubleTwist, Inc., Oakland, Calif.), which contains all the EST and non-redundant sequence in public databases.

Through contig assembly and the use of homology searching software programs, the sequence information provided herein can be readily extended to confirm, or confirm a predicted, gene having the sequence of the polynucleotides described in the present invention. Further the information obtained can be used to identify the function of the gene product of the gene corresponding to the polynucleotides described herein. While not necessary to the practice of the invention, identification of the function of the corresponding gene, can provide guidance in the design of therapeutics that target the gene to modulate its activity and modulate the cancerous phenotype (e.g., inhibit metastasis, proliferation, and the like).

Example 19

Source of Biological Materials

The biological materials used in the experiments that led to the present invention are described below.

Source of Patient Tissue Samples

Normal and cancerous tissues were collected from patients using laser capture microdissection (LCM) techniques, which techniques are well known in the art (see, e.g., Ohyama et al. (2000) Biotechniques 29:530-6; Curran et al. (2000) Mol. Pathol. 53:64-8; Suarez-Quian et al. (1999) Biotechniques 26:328-35; Simone et al. (1998) Trends Genet 14:272-6; Conia et al. (1997) J. Clin. Lab. Anal. 11:28-38; Emmert-Buck et al. (1996) Science 274:998-1001). Table 14 below provides information about each patient from which the prostate tissue samples were isolated, including: 1) the "Patient ID", which is a number assigned to the patient for identification purposes; 2) the "Tissue Type"; and 3) the "Gleason Grade" of the tumor. Histopathology of all primary tumors indicated the tumor was adenocarcinoma.

TABLE 14

Prostate patient data.

| Patient ID | Tissue Type | Gleason Grade |
| --- | --- | --- |
| 93 | Prostate Cancer | 3 + 4 |
| 94 | Prostate Cancer | 3 + 3 |
| 95 | Prostate Cancer | 3 + 3 |
| 96 | Prostate Cancer | 3 + 3 |
| 97 | Prostate Cancer | 3 + 2 |
| 100 | Prostate Cancer | 3 + 3 |
| 101 | Prostate Cancer | 3 + 3 |
| 104 | Prostate Cancer | 3 + 3 |
| 105 | Prostate Cancer | 3 + 4 |
| 106 | Prostate Cancer | 3 + 3 |
| 138 | Prostate Cancer | 3 + 3 |
| 151 | Prostate Cancer | 3 + 3 |
| 153 | Prostate Cancer | 3 + 3 |
| 155 | Prostate Cancer | 4 + 3 |
| 171 | Prostate Cancer | 3 + 4 |
| 173 | Prostate Cancer | 3 + 4 |
| 231 | Prostate Cancer | 3 + 4 |
| 232 | Prostate Cancer | 3 + 3 |
| 251 | Prostate Cancer | 3 + 4 |
| 282 | Prostate Cancer | 4 + 3 |
| 286 | Prostate Cancer | 3 + 3 |
| 294 | Prostate Cancer | 3 + 4 |
| 351 | Prostate Cancer | 5 + 4 |
| 361 | Prostate Cancer | 3 + 3 |
| 362 | Prostate Cancer | 3 + 3 |
| 365 | Prostate Cancer | 3 + 2 |
| 368 | Prostate Cancer | 3 + 3 |
| 379 | Prostate Cancer | 3 + 4 |
| 388 | Prostate Cancer | 5 + 3 |
| 391 | Prostate Cancer | 3 + 3 |
| 420 | Prostate Cancer | 3 + 3 |
| 425 | Prostate Cancer | 3 + 3 |
| 428 | Prostate Cancer | 4 + 3 |
| 431 | Prostate Cancer | 3 + 4 |
| 492 | Prostate Cancer | 3 + 3 |
| 493 | Prostate Cancer | 3 + 4 |
| 496 | Prostate Cancer | 3 + 3 |
| 510 | Prostate Cancer | 3 + 3 |
| 511 | Prostate Cancer | 4 + 3 |
| 514 | Prostate Cancer | 3 + 3 |
| 549 | Prostate Cancer | 3 + 3 |
| 552 | Prostate Cancer | 3 + 3 |

TABLE 14-continued

Prostate patient data.

| Patient ID | Tissue Type | Gleason Grade |
|---|---|---|
| 858 | Prostate Cancer | 3 + 4 |
| 859 | Prostate Cancer | 3 + 4 |
| 864 | Prostate Cancer | 3 + 4 |
| 883 | Prostate Cancer | 4 + 4 |
| 895 | Prostate Cancer | 3 + 3 |
| 901 | Prostate Cancer | 3 + 3 |
| 909 | Prostate Cancer | 3 + 3 |
| 921 | Prostate Cancer | 3 + 3 |
| 923 | Prostate Cancer | 4 + 3 |
| 934 | Prostate Cancer | 3 + 3 |
| 1134 | Prostate Cancer | 3 + 4 |
| 1135 | Prostate Cancer | 3 + 3 |
| 1136 | Prostate Cancer | 3 + 4 |
| 1137 | Prostate Cancer | 3 + 3 |
| 1138 | Prostate Cancer | 4 + 3 |

Source of Polynucleotides on Arrays

Polynucleotides for use on the arrays were obtained from both publicly available sources and from cDNA libraries generated from selected cell lines and patient tissues. Table 15 provides information about the polynucleotides on the arrays including: 1) the "SEQ ID NO" assigned to each sequence for use in the present specification; 2) the spot identification number ("Spot ID"), an internal reference that serves as a unique identifier for the spot on the array; 3) the "Sequence Name" assigned to each sequence; and 4) the "Sample Name or Clone Name" assigned to the sample or clone from which the sequence was isolated. The sequences corresponding to the SEQ ID NOS are provided in the Sequence Listing.

Characterization of Sequences

The sequences of the isolated polynucleotides were first masked to eliminate low complexity sequences using the RepeatMasker masking program, publicly available through a web site supported by the University of Washington (See also Smit, A. F. A. and Green, P., unpublished results). Generally, masking does not influence the final search results, except to eliminate sequences of relative little interest due to their low complexity, and to eliminate multiple "hits" based on similarity to repetitive regions common to multiple sequences, e.g., Alu repeats. Masking resulted in the elimination of several sequences.

The remaining sequences of the isolated polynucleotides were used in a homology search of the GenBank database using the TeraBLAST program (TimeLogic, Crystal Bay, Nev.), a DNA and protein sequence homology searching algorithm. TeraBLAST is a version of the publicly available BLAST search algorithm developed by the National Center for Biotechnology, modified to operate at an accelerated speed with increased sensitivity on a specialized computer hardware platform. The program was run with the default parameters recommended by TimeLogic to provide the best sensitivity and speed for searching DNA and protein sequences. Gene assignment for the query sequences was determined based on best hit form the GenBank database; expectancy values are provided with the hit.

Summary of TeraBLAST Search Results

Tables 16 and 17 (on a CD ROM filed herewith) provide information about the gene corresponding to each polynucleotide. Tables 16 and 17 include: 1) the spot identification number ("Spot ID"); 2) the GenBank Accession Number of the publicly available sequence corresponding to the polynucleotide ("GenBankHit"); 3) a description of the GenBank sequence ("GenBankDesc"); and 4) the score of the similarity of the polynucleotide sequence and the GenBank sequence ("GenBankScore"). The published information for each GenBank and EST description, as well as the corresponding sequence identified by the provided accession number, are incorporated herein by reference.

Example 20

Detection of Differential Expression Using Arrays cDNA probes were prepared from total RNA isolated from the patient cells described above. Since LCM provides for the isolation of specific cell types to provide a substantially homogenous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) Nature Med 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from normal cell RNA sample. For example, the cDNA probes from the normal cells were labeled with Cy3 fluorescent dye (green) and the cDNA probes prepared from the tumor cells were labeled with Cy5 fluorescent dye (red), and vice versa.

Each array used had an identical spatial layout and control spot set. Each microarray was divided into two areas, each area having an array with, on each half, twelve groupings of 32×12 spots, for a total of about 9,216 spots on each array. The two areas are spotted identically which provide for at least two duplicates of each clone per array.

Polynucleotides for use on the arrays were obtained from both publicly available sources and from cDNA libraries generated from selected cell lines and patient tissues as described above and in Table 14. PCR products of from about 0.5 kb to 2.0 kb amplified from these sources were spotted onto the array using a Molecular Dynamics Gen III spotter according to the manufacturer's recommendations. The first row of each of the 24 regions on the array had about 32 control spots, including 4 negative control spots and 8 test polynucleotides. The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about four duplicate measurements for each clone, two of one color and two of the other, for each sample.

The differential expression assay was performed by mixing equal amounts of probes from tumor cells and normal cells of the same patient. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p>10^{-3}$, and the differential ratio was set to 1.000 for those spots. All other spots have a significant difference in expression between the tumor and normal sample. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level ($p>0.05$).

TABLE 15

| SEQ ID NO | Spot Id | Sequence Name | Sample Name or Clone Name |
|---|---|---|---|
| 342 | 987 | gbH13036.1 | NIH50__43563 |
| 343 | 1016 | 019.G8.sp6__128478 | M00006968D:E03 |
| 344 | 1019 | 1chip1.K15.T7HSQ3__328869 | M00005636D:B08 |
| 345 | 1033 | RTA00000184AR.p.16.1 | M00001568C:D03 |
| 346 | 1047 | 122.B4.sp6__132088 | M00001655C:E04 |
| 347 | 1049 | 324.E8.sp6__145687 | M00001657A:C02 |
| 348 | 149 | 4chip1.F13.SP6__329984 | M00001470A:C06 |
| 349 | 260 | HX2105-6 | 2105-6 |
| 350 | 279 | gbR51346.1 | NIH50__39093 |
| 351 | 283 | gbH05914.1 | NIH50__43550 |
| 352 | 315 | 1chip1.K13.T7HSQ3__328837 | M00005629C:E09 |
| 353 | 320 | 1chip1.P13.T7HSQ3__328842 | M00006964D:C05 |
| 354 | 342 | 626.C7.sp6__157434 | M00007965A:C03 |
| 355 | 369 | SL178m13 | SL178 |
| 356 | 403 | RTA00000848F.c.07.1 | M00023298C:E11 |
| 357 | 453 | 3chip1.F02.T7HSQ3__329424 | M00008050A:D12 |
| 358 | 460 | 40000063.F01.T7HSQ3__332264 | M00022135A:C04 |
| 359 | 462 | 642.G1.sp6__156335 | M00022137A:A05 |
| 360 | 507 | RTA00000603F.b.03.1 | M00004163D:A08 |
| 361 | 511 | 774.H7.sp6__162527 | M00004167D:H05 |
| 362 | 515 | 627.B2.sp6__157609 | M00007976D:D10 |
| 363 | 530 | 636.A2.sp6__158173 | M00022004A:F05 |
| 364 | 578 | 271.A1.sp6__145248 | M00001429A:G04 |
| 365 | 579 | 269.B1.sp6__144876 | M00001358B:F05 |
| 366 | 582 | 271.C1.sp6__145272 | M00001429C:C03 |
| 367 | 589 | 269.G1.sp6__144936 | M00001360C:B05 |
| 368 | 596 | 271.B7.sp6__145266 | M00001445D:D07 |
| 369 | 605 | 6chip1.N13.SP6__330760 | M00001374D:D10 |
| 370 | 627 | 8chip1.C14.Topo2__336359 | 2016-5 |
| 371 | 635 | HX2058-2 | 2058-2 |
| 372 | 637 | HX2090-1 | 2090-1 |
| 373 | 641 | 1chip1.A02.T7HSQ3__328651 | M00006600A:E02 |
| 374 | 653 | RTA00000321F.e.05.1 | M00006619A:C04 |
| 375 | 656 | 959.SP6.H01__180102 | M00007082B:D06 |
| 376 | 688 | RTA00001082F.m.03.1 | M00027211C:F06 |
| 377 | 742 | 660.C2.sp6__159543 | M00026921D:F12 |
| 378 | 760 | 6chip1.G15.SP6__330785 | M00026961D:G06 |
| 379 | 764 | RTA00001069F.i.01.1 | M00026962D:E01 |
| 380 | 770 | 021.A2.sp6__128760 | M00005467A:G06 |
| 381 | 784 | 021.H2.sp6__128844 | M00007007A:H06 |
| 382 | 789 | 5chip1.E16.SP6__330415 | M00001393B:B01 |
| 383 | 816 | 40000062.H02.T7HSQ3__332178 | M00008095B:G07 |

TABLE 15-continued

| SEQ ID NO | Spot Id | Sequence Name | Sample Name or Clone Name |
|---|---|---|---|
| 384 | 828 | 634.F8.sp6__155946 | M00021638B:F03 |
| 385 | 866 | RTA22200231F.p.10.1.P | M00008002B:G03 |
| 386 | 920 | 656.D8.sp6__159369 | M00026896A:C09 |
| 387 | 929 | 919.A2.SP6__168666 | M00001339C:G05 |
| 388 | 964 | HX2106-1 | 2106-1 |
| 389 | 978 | HX2103-1 | 2103-1 |
| 390 | 1061 | 8chip1.E03.Topo2__336185 | SL141 |
| 391 | 1108 | 661.B8.sp6__159729 | M00027116A:A10 |
| 392 | 1111 | RTA00001069F.b.02.1 | M00023302D:E10 |
| 393 | 1117 | 653.G8.sp6__159021 | M00023305A:C02 |
| 394 | 1137 | 022.A6.sp6__128956 | M00007943C:f02 |
| 395 | 1145 | 019.G8.sp6__128478 | M00006968D:e03 |
| 396 | 1176 | 642.D8.sp6__156306 | M00022180D:E11 |
| 397 | 1195 | 5chip1.K03.SP6__330213 | M00001675B:G05 |
| 398 | 1251 | RTA00001038F.a.21.1 | M00023413D:F04 |
| 399 | 1261 | 655.G2.sp6__156528 | M00023419C:B06 |
| 400 | 1266 | RTA00000922F.g.12.1 | M00026900D:F02 |
| 401 | 1282 | 271.A2.sp6__145249 | M00001430D:H07 |
| 402 | 1283 | 6chip1.D03.SP6__330590 | M00001360D:H10 |
| 403 | 1298 | RTA00000585F.o.09.2 | M00001448A:C04 |
| 404 | 1307 | 269.F8.sp6__144931 | M00001378D:E03 |
| 405 | 1309 | 269.G8.sp6__144943 | M00001378D:G05 |
| 406 | 1310 | 271.G8.sp6__145327 | M00001451D:F01 |
| 407 | 1319 | HX2030-2 | 2030-2 |
| 408 | 1323 | 8chip1.K04.Topo2__336207 | 2054-2 |
| 409 | 1325 | HX2076-5 | 2076-5 |
| 410 | 1331 | HX2017-1 | 2017-1 |
| 411 | 1341 | HX2090-3 | 2090-3 |
| 412 | 1351 | 1chip1.G04.T7HSQ3__328689 | M00006630A:D01 |
| 413 | 1466 | RTA00000852F.h.21.1 | M00026964B:H10 |
| 414 | 1506 | 40000062.A03.T7HSQ3__332179 | M00008095C:A10 |
| 415 | 1524 | 40000062.B09.T7HSQ3__332228 | M00021649B:F09 |
| 416 | 1607 | 323.D3.sp6__145478 | M00001497A:A09 |
| 417 | 1644 | 020.A2.sp6__128592 | M00001393B:B01 |
| 418 | 1645 | 919.G3.SP6__168739 | M00001342C:C01 |
| 419 | 1659 | 268.F9.sp6__144740 | M00001350B:D10 |
| 420 | 1663 | 919.H9.SP6__168757 | M00001350C:C05 |
| 421 | 1664 | 270.H9.sp6__145148 | M00001411A:G02 |
| 422 | 1689 | gbR61053.1 | NIH50__42096 |
| 423 | 1693 | gbH16957.1 | NIH50__50117 |
| 424 | 1723 | 1chip1.K17.T7HSQ3__328901 | M00005694A:A09 |
| 425 | 1752 | 626.D9.sp6__157448 | M00007967D:G06 |
| 426 | 1767 | SL149m13 | SL149 |
| 427 | 1769 | 8chip1.I05.Topo2__336221 | SL150 |
| 428 | 1789 | 8chip1.M17.Topo2__336417 | SL200 |
| 429 | 1791 | SL201m13 | SL201 |
| 430 | 1794 | 661.A3.sp6__159712 | M00027028A:A06 |
| 431 | 1807 | 653.H3.sp6__159028 | M00023285D:C05 |
| 432 | 1810 | RTA00001069F.k.22.1 | M00027143D:E10 |
| 433 | 1852 | 1chip1.L18.T7HSQ3__328918 | M00005380A:E11 |
| 434 | 1859 | 3chip1.D06.T7HSQ3__329486 | M00008057A:B01 |
| 435 | 1868 | 642.F3.sp6__156325 | M00022151A:B12 |
| 436 | 1895 | RTA22200222F.k.17.1.P | M00004069B:G01 |
| 437 | 1899 | RTA00000603F.a.21.1 | M00004072D:E08 |
| 438 | 1927 | RTA22200231F.l.22.1.P | M00007985A:B08 |
| 439 | 1936 | RTA00000854F.g.12.1 | M00008020C:H09 |
| 440 | 1955 | 655.B3.sp6__156469 | M00023423B:A04 |
| 441 | 1957 | 655.C3.sp6__156481 | M00023424C:A01 |
| 442 | 1992 | 271.D3.sp6__145286 | M00001434D:F08 |
| 443 | 2000 | 271.H3.sp6__145334 | M00001435C:F08 |
| 444 | 2014 | 4chip1.M17.SP6__330055 | M00001462A:E06 |
| 445 | 2028 | 8chip1.L06.Topo2__336240 | 2237-3 |
| 446 | 2030 | 8chip1.N06.Topo2__336242 | 2245-1 |
| 447 | 2067 | 1chip1.C18.T7HSQ3__328909 | M00006715C:C09 |
| 448 | 2108 | RTA00001083F.e.05.1 | M00027619D:A06 |
| 449 | 2110 | RTA00001083F.e.06.1 | M00027622D:H04 |
| 450 | 2137 | sl102t7 | SL102 |
| 451 | 2139 | sl103m13 | SL103 |
| 452 | 2152 | RTA22200241F.k.11.1.P | M00026931B:E12 |
| 453 | 2190 | 021.G4.sp6__128834 | M00006953B:C05 |
| 454 | 2237 | 3chip1.N19.T7HSQ3__329704 | M00007943D:B09 |
| 455 | 2267 | 773.F10.sp6__162349 | M00001573D:H09 |
| 456 | 2280 | RTA00001206F.a.07.1 | M00008023B:A05 |
| 457 | 2338 | 270.A4.sp6__145059 | M00001394C:B12 |
| 458 | 2357 | 268.C10.sp6__144705 | M00001351A:A01 |
| 459 | 2375 | gbR35294.1 | NIH50__37451 |

TABLE 15-continued

| SEQ ID NO | Spot Id | Sequence Name | Sample Name or Clone Name |
|---|---|---|---|
| 460 | 2381 | gbH09589.1 | NIH50__46171 |
| 461 | 2427 | RTA00001064F.k.13.2 | M00005767D:B03 |
| 462 | 2442 | 626.E4.sp6__157455 | M00007960A:D12 |
| 463 | 2513 | 653.A10.sp6__158951 | M00023312D:F10 |
| 464 | 2514 | 661.A10.sp6__159719 | M00027168A:E01 |
| 465 | 2528 | 661.H10.sp6__159803 | M00027176D:B08 |
| 466 | 2549 | 019.E10.sp6__128456 | M00005645D:g06 |
| 467 | 2557 | 020.G4.sp6__128666 | M00005404C:f02 |
| 468 | 2564 | RTA22200232F.o.21.1.P | M00022154C:D08 |
| 469 | 2568 | 642.D4.sp6__156302 | M00022158D:C11 |
| 470 | 2588 | 642.F10.sp6__156332 | M00022208D:B02 |
| 471 | 2605 | 774.G4.sp6__162502 | M00004085C:C02 |
| 472 | 2613 | 774.C10.sp6__162546 | M00004243D:C01 |
| 473 | 2621 | RTA00000193AR.c.15.2 | M00004248B:E08 |
| 474 | 2629 | RTA22200231F.m.13.1.P | M00007987B:F11 |
| 475 | 2632 | RTA22200233F.c.14.1.P | M00008025D:A02 |
| 476 | 2662 | RTA00001069F.c.03.1 | M00023363C:A04 |
| 477 | 2663 | RTA00000786F.o.16.3 | M00023431C:F07 |
| 478 | 2694 | 271.C4.sp6__145275 | M00001436B:E11 |
| 479 | 2696 | 271.D4.sp6__145287 | M00001436C:C03 |
| 480 | 2702 | 271.G4.sp6__145323 | M00001437B:B08 |
| 481 | 2716 | 271.F10.sp6__145317 | M00001468A:D02 |
| 482 | 2728 | 8chip1.H08.Topo2__336268 | 2208-5 |
| 483 | 2732 | HX2237-4 | 2237-4 |
| 484 | 2734 | HX2245-2 | 2245-2 |
| 485 | 2736 | HX2254-2 | 2254-2 |
| 486 | 2751 | HX2100-1 | 2100-1 |
| 487 | 2765 | 955.SP6.G04__177960 | M00006653C:B09 |
| 488 | 2766 | RTA22200230F.g.19.1.P | M00007154B:H08 |
| 489 | 2791 | RTA00000789F.g.11.1 | M00003994A:G12 |
| 490 | 2837 | sl108m13 | SL108 |
| 491 | 2919 | 625.D5.sp6__155727 | M00007936A:C09 |
| 492 | 2922 | 959.SP6.G09__180098 | M00008100B:G11 |
| 493 | 2977 | RTA22200231F.m.16.1.P | M00007990D:A11 |
| 494 | 2979 | RTA22200231F.m.20.1.P | M00007992A:D02 |
| 495 | 2988 | 628.F9.sp6__157856 | M00008039A:C09 |
| 496 | 3009 | 323.A5.sp6__145444 | M00001503C:D01 |
| 497 | 3090 | HX2104-3 | 2104-3 |
| 498 | 3091 | gbR42581.1 | NIH50__31143 |
| 499 | 3093 | gbR45594.1 | NIH50__35483 |
| 500 | 3097 | gbR61295.1 | NIH50__42352 |
| 501 | 3099 | gbH05820.1 | NIH50__44255 |
| 502 | 3101 | gbH16908.1 | NIH50__50666 |
| 503 | 3122 | 019.G10.sp6__128480 | M00007019A:B01 |
| 504 | 3143 | 324.D5.sp6__145672 | M00001605D:C02 |
| 505 | 3152 | 626.H5.sp6__157492 | M00007963B:B04 |
| 506 | 3235 | 019.D5.sp6__128439 | M00005443D:b03 |
| 507 | 3275 | 633.F5.sp6__156135 | M00008072D:E12 |
| 508 | 3284 | 642.B11.sp6__156285 | M00022211D:A02 |
| 509 | 3301 | 5chip1.E09.SP6__330303 | M00003820A:G06 |
| 510 | 3317 | 774.C11.sp6__162554 | M00004282B:D11 |
| 511 | 3346 | 636.A10.sp6__158181 | M00022068C:F05 |
| 512 | 3372 | RTA00000854F.m.01.1 | M00023395C:F06 |
| 513 | 3394 | 271.A5.sp6__145252 | M00001437D:E12 |
| 514 | 3396 | 271.B5.sp6__145264 | M00001438A:B09 |
| 515 | 3419 | 269.F11.sp6__144934 | M00001387A:A08 |
| 516 | 3440 | HX2254-4 | 2254-4 |
| 517 | 3453 | HX2093-3 | 2093-3 |
| 518 | 3455 | HX2100-2 | 2100-2 |
| 519 | 3469 | RTA00002902F.h.07.1.P | M00006678A:A03 |
| 520 | 3517 | RTA22200224F.j.03.1.P | M00005358D:A11 |
| 521 | 3531 | SL66t7 | SL66 |
| 522 | 3575 | 654.D12.sp6__159181 | M00023398C:D01 |
| 523 | 3683 | RTA00000717F.o.13.1 | M00007994C:F08 |
| 524 | 3710 | RTA22200232F.i.18.1.P | M00022074D:H11 |
| 525 | 3712 | 636.H11.sp6__158266 | M00022075A:B09 |
| 526 | 3745 | 268.A6.sp6__144677 | M00001344D:H07 |
| 527 | 3760 | 013717 | M00001405B:A11 |
| 528 | 3772 | 270.F12.sp6__145127 | M00001427D:G03 |
| 529 | 3776 | 270.H12.sp6__145151 | M00001428C:A07 |
| 530 | 3785 | gbR58991.1 | NIH50__41452 |
| 531 | 3794 | HX2105-1 | 2105-1 |
| 532 | 3831 | 1chip1.G23.T7HSQ3__328993 | M00006582A:D11 |
| 533 | 4007 | RTA22200222F.m.10.1.P | M00004136A:D10 |
| 534 | 4019 | 774.B12.sp6__162561 | M00004331A:A03 |
| 535 | 4037 | RTA22200231F.o.10.1.P | M00007996C:F04 |

TABLE 15-continued

| SEQ ID NO | Spot Id | Sequence Name | Sample Name or Clone Name |
|---|---|---|---|
| 536 | 4068 | 344.B6.sp6__146241 | M00023397B:E08 |
| 537 | 4100 | 4chip1.C11.SP6__329949 | M00001441A:A09 |
| 538 | 4107 | 920.F6.SP6__168826 | M00001372A:D01 |
| 539 | 4123 | 019.A4.sp6__128402 | M00001389A:F09 |
| 540 | 4124 | 4chip1.K23.SP6__330149 | M00001481C:A12 |
| 541 | 4127 | 6chip1.P23.SP6__330922 | M00001389C:G01 |
| 542 | 4128 | 4chip1.O23.SP6__330153 | M00001482D:D11 |
| 543 | 4135 | HX2032-2 | 2032-2 |
| 544 | 4157 | HX2093-5 | 2093-5 |
| 545 | 4193 | RTA00002895F.h.23.1.P | M00004087B:E02 |
| 546 | 8454 | 2231168 | I:2231168:08B01:C01 |
| 547 | 8486 | 1813269 | I:1813269:05B01:C01 |
| 548 | 8509 | 1732092 | I:1732092:05A01:G07 |
| 549 | 8513 | Incyte3.A01.T3pINCY__352048 | I:3325119:07A01:A01 |
| 550 | 8537 | Incyte3.I13.T3pINCY__352248 | I:3176222:07A01:E07 |
| 551 | 8546 | Incyte2.B01.T3pINCY__351665 | I:1705208:06B01:A01 |
| 552 | 8549 | Incyte2.E01.T3pINCY__351668 | I:1623214:06A01:C01 |
| 553 | 8568 | Incyte2.H13.T3pINCY__351863 | I:1712888:06B01:D07 |
| 554 | 8569 | Incyte2.I13.T3pINCY__351864 | I:1702752:06A01:E07 |
| 555 | 8570 | 1696224 | I:1696224:06B01:E07 |
| 556 | 8599 | Incyte5.H13.T3pINCY__353015 | I:1678926:11A01:D07 |
| 557 | 8608 | 3676190 | I:3676190:11B01:H07 |
| 558 | 8634 | Incyt14.I13.T3pINCY__377264 | I:1439934:03B01:E07 |
| 559 | 8637 | 1640555 | I:1640555:03A01:G07 |
| 560 | 8644 | Incyt12.C01.T3pINCY__368180 | I:2171743:01B01:B01 |
| 561 | 8672 | 2885982 | I:2885982:01B01:H07 |
| 562 | 8703 | 2917169 | I:2917169:12A01:H07 |
| 563 | 8730 | 2477854 | I:2477854:10B01:E07 |
| 564 | 8743 | 1858905 | I:1858905:04A01:D01 |
| 565 | 8829 | 2950228 | I:2950228:08A02:G07 |
| 566 | 8835 | 1732335 | I:1732335:05A02:B01 |
| 567 | 8856 | I1.H14.T3pINCY1__343720 | I:1803418:05B02:D07 |
| 568 | 8858 | I1.J14.T3pINCY1__343722 | I:1857652:05B02:E07 |
| 569 | 8860 | I1.L14.T3pINCY1__343724 | I:1568725:05B02:F07 |
| 570 | 8862 | I1.N14.T3pINCY1__343726 | I:1687060:05B02:G07 |
| 571 | 8890 | 3044552 | I:3044552:07B02:E07 |
| 572 | 8945 | Incyte5.B14.T3pINCY__353025 | I:3282436:11A02:A07 |
| 573 | 8959 | 1817388 | I:1817388:11A02:H07 |
| 574 | 8960 | Incyt10.O14.T3pINCY__367632 | I:2488216:11B02:H07 |
| 575 | 8996 | Incyt11.D02.T3pINCY__367813 | I:2365149:01B02:B01 |
| 576 | 9008 | Incyte8.P01.T3pINCY__354174 | I:3211615:01B02:H01 |
| 577 | 9013 | Incyte8.E14.T3pINCY__354371 | I:1419396:01A02:C07 |
| 578 | 9021 | Incyt11.N13.T3pINCY__367999 | I:2862971:01A02:G07 |
| 579 | 9055 | Incyt6.P13.T3pINCY__353598 | I:4335824:12A02:H07 |
| 580 | 9082 | 3275493 | I:3275493:10B02:E07 |
| 581 | 9097 | 2021576 | I:2021576:04A02:E01 |
| 582 | 9110 | Incyt14.F14.T3pINCY__377277 | I:2989411:04B02:C07 |
| 583 | 9111 | I1.G14.T3pINCY1__343719 | I:1958902:04A02:D07 |
| 584 | 9143 | 2728590 | I:2728590:02A02:D07 |
| 585 | 9168 | Incyte4.O03.T3pINCY__352478 | I:2344817:08B01:H02 |
| 586 | 9171 | Incyte3.D16.T3pINCY__352291 | I:3236109:08A01:B08 |
| 587 | 9186 | 1574890 | I:1574890:05B01:A02 |
| 588 | 9191 | 1421929 | I:1421929:05A01:D02 |
| 589 | 9201 | 3142736 | I:3142736:05A01:A08 |
| 590 | 9278 | Incyte2.N15.T3pINCY__351901 | I:1305950:06B01:G08 |
| 591 | 9296 | Incyt10.O03.T3pINCY__367456 | I:1804548:11B01:H02 |
| 592 | 9300 | Incyt10.C15.T3pINCY__367636 | I:3053958:11B01:B08 |
| 593 | 9312 | Incyt10.O15.T3pINCY__367648 | I:2799347:11B01:H08 |
| 594 | 9318 | Incyt14.E03.T3pINCY__377100 | I:1312824:03B01:C02 |
| 595 | 9348 | 2745048 | I:2745048:01B01:B02 |
| 596 | 9364 | 2683564 | I:2683564:01B01:B08 |
| 597 | 9366 | Incyt12.E15.T3pINCY__368406 | I:2725511:01B01:C08 |
| 598 | 9368 | Incyte8.H16.T3pINCY__354406 | I:2233375:01B01:D08 |
| 599 | 9381 | Incyt10.F03.T3pINCY__367447 | I:3218334:12A01:C02 |
| 600 | 9442 | I1.B03.T3pINCY1__343538 | I:1636639:04B01:A02 |
| 601 | 9448 | I1.H03.T3pINCY1__343544 | I:2455617:04B01:D02 |
| 602 | 9456 | I1.P03.T3pINCY1__343552 | I:2806166:04B01:H02 |
| 603 | 9472 | I1.P15.T3pINCY1__343744 | I:2510171:04B01:H08 |
| 604 | 9487 | Incyt12.O04.T3pINCY__368240 | I:2190284:02A01:H02 |
| 605 | 9499 | Incyte7.K15.T3pINCY__354009 | I:1861971:02A01:F08 |
| 606 | 9501 | 3360454 | I:3360454:02A01:G08 |
| 607 | 9512 | 2948256 | I:2948256:08B02:D02 |
| 608 | 9527 | 2045705 | I:2045705:08A02:D08 |
| 609 | 9528 | 2544622 | I:2544622:08B02:D08 |
| 610 | 9540 | 1522716 | I:1522716:05B02:B02 |
| 611 | 9552 | I1.P04.T3pINCY1__343568 | I:1820522:05B02:H02 |

TABLE 15-continued

| SEQ ID NO | Spot Id | Sequence Name | Sample Name or Clone Name |
|---|---|---|---|
| 612 | 9553 | 2365295 | I:2365295:05A02:A08 |
| 613 | 9560 | I1.H16.T3pINCY1_343752 | I:1822577:05B02:D08 |
| 614 | 9574 | 2472778 | I:2472778:07B02:C02 |
| 615 | 9596 | 3141918 | I:3141918:07B02:F08 |
| 616 | 9618 | 1306814 | I:1306814:06B02:A08 |
| 617 | 9624 | Incyte2.H16.T3pINCY_351911 | I:3034694:06B02:D08 |
| 618 | 9640 | Incyt10.G04.T3pINCY_367464 | I:2859033:11B02:D02 |
| 619 | 9645 | Incyte5.N04.T3pINCY_352877 | I:2795249:11A02:G02 |
| 620 | 9647 | Incyte5.P04.T3pINCY_352879 | I:2966535:11A02:H02 |
| 621 | 9649 | Incyte5.B16.T3pINCY_353057 | I:1483713:11A02:A08 |
| 622 | 9666 | Incyt14.A04.T3pINCY_377112 | I:1453049:03B02:A02 |
| 623 | 9678 | Incyt14.M04.T3pINCY_377124 | I:1415990:03B02:G02 |
| 624 | 9687 | Incyte9.G15.T3pINCY_354773 | I:2992851:03A02:D08 |
| 625 | 9697 | Incyt11.B03.T3pINCY_367827 | I:1477568:01A02:A02 |
| 626 | 9698 | 2779637 | I:2779637:01B02:A02 |
| 627 | 9716 | Incyt11.D16.T3pINCY_368037 | I:2786575:01B02:B08 |
| 628 | 9720 | Incyt11.H16.T3pINCY_368041 | I:2455118:01B02:D08 |
| 629 | 9722 | Incyt11.J16.T3pINCY_368043 | I:2840251:01B02:E08 |
| 630 | 9739 | 2902903 | I:2902903:12A02:F02 |
| 631 | 9741 | Incyte6.N03.T3pINCY_353436 | I:3126828:12A02:G02 |
| 632 | 9755 | 3126622 | I:3126622:12A02:F08 |
| 633 | 9770 | Incyte5.I04.T3pINCY_352872 | I:2911347:10B02:E02 |
| 634 | 9884 | Incyte4.K17.T3pINCY_352698 | I:2908878:08B01:F09 |
| 635 | 9889 | 2639181 | I:2639181:05A01:A03 |
| 636 | 9901 | 3132987 | I:3132987:05A01:G03 |
| 637 | 9911 | 3139163 | I:3139163:05A01:D09 |
| 638 | 9913 | 2242817 | I:2242817:05A01:E09 |
| 639 | 9914 | 1904751 | I:1904751:05B01:E09 |
| 640 | 9916 | 1750553 | I:1750553:05B01:F09 |
| 641 | 9920 | 1888940 | I:1888940:05B01:H09 |
| 642 | 9949 | Incyte3.M17.T3pINCY_352316 | I:3970665:07A01:G09 |
| 643 | 9952 | Incyte3.P17.T3pINCY_352319 | I:1633393:07B01:H09 |
| 644 | 9956 | Incyte2.D05.T3pINCY_351731 | I:1617326:06B01:B03 |
| 645 | 9981 | Incyte2.M17.T3pINCY_351932 | I:1720149:06A01:G09 |
| 646 | 9989 | Incyte5.F05.T3pINCY_352885 | I:2689747:11A01:C03 |
| 647 | 9995 | Incyte5.L05.T3pINCY_352891 | I:2367733:11A01:F03 |
| 648 | 10003 | 1850531 | I:1850531:11A01:B09 |
| 649 | 10012 | Incyt10.K17.T3pINCY_367676 | I:2594407:11B01:F09 |
| 650 | 10020 | Incyt14.C05.T3pINCY_377130 | I:1406786:03B01:B03 |
| 651 | 10021 | 1930235 | I:1930235:03A01:C03 |
| 652 | 10035 | I1.C17.T3pINCY1_343763 | I:1526240:03A01:B09 |
| 653 | 10046 | Incyt14.M17.T3pINCY_377332 | I:1510714:03B01:G09 |
| 654 | 10047 | I1.O17.T3pINCY1_343775 | I:2952864:03A01:H09 |
| 655 | 10083 | 2922292 | I:2922292:12A01:B03 |
| 656 | 10103 | Incyte6.G18.T3pINCY_353669 | I:3714075:12A01:D09 |
| 657 | 10153 | Incyt14.J05.T3pINCY_377137 | I:1712592:04A01:E03 |
| 658 | 10160 | I1.P05.T3pINCY1_343584 | I:2696735:04B01:H03 |
| 659 | 10200 | Incyte7.H17.T3pINCY_354038 | I:1702266:02B01:D09 |
| 660 | 10231 | 1808121 | I:1808121:08A02:D09 |
| 661 | 10243 | Incyt15.C05.T3pINCY_377526 | I:3070110:05A02:B03 |
| 662 | 10257 | Incyt15.A17.T3pINCY_377716 | I:2860815:05A02:A09 |
| 663 | 10285 | Incyte3.M06.T3pINCY_352140 | I:1930135:07A02:G03 |
| 664 | 10301 | 2669174 | I:2669174:07A02:G09 |
| 665 | 10334 | Incyte2.N18.T3pINCY_351949 | I:3354893:06B02:G09 |
| 666 | 10355 | Incyte5.D18.T3pINCY_353091 | I:4215852:11A02:B09 |
| 667 | 10366 | Incyt10.M18.T3pINCY_367694 | I:2896792:11B02:G09 |
| 668 | 10374 | Incyt14.E06.T3pINCY_377148 | I:1513989:03B02:C03 |
| 669 | 10388 | Incyt14.C18.T3pINCY_377338 | I:1453450:03B02:B09 |
| 670 | 10463 | Incyte6.P17.T3pINCY_353662 | I:4592475:12A02:H09 |
| 671 | 10481 | Incyte5.A17.T3pINCY_353072 | I:1726307:10A02:A09 |
| 672 | 10508 | Incyt14.L06.T3pINCY_377155 | I:1900378:04B02:F03 |
| 673 | 10519 | 1655492 | I:1655492:04A02:D09 |
| 674 | 10569 | Incyte3.J08.T3pINCY_352169 | I:2447969:08A01:E04 |
| 675 | 10594 | 1871362 | I:1871362:05B01:A04 |
| 676 | 10601 | 1337615 | I:1337615:05A01:E04 |
| 677 | 10650 | Incyte3.J19.T3pINCY_352345 | I:2456393:07B01:E10 |
| 678 | 10674 | Incyte2.B19.T3pINCY_351953 | I:1911622:06B01:A10 |
| 679 | 10684 | 4082816 | I:4082816:06B01:F10 |
| 680 | 10686 | Incyte2.N19.T3pINCY_351965 | I:1450849:06B01:G10 |
| 681 | 10746 | Incyt14.I19.T3pINCY_377360 | I:1445895:03B01:E10 |
| 682 | 10762 | Incyte8.J08.T3pINCY_354280 | I:2852042:01B01:E04 |
| 683 | 10766 | 2071761 | I:2071761:01B01:G04 |
| 684 | 10767 | Incyt11.O08.T3pINCY_367920 | I:1336836:01A01:H04 |
| 685 | 10777 | 2591814 | I:2591814:01A01:E10 |
| 686 | 10801 | Incyt10.B19.T3pINCY_367699 | I:3951088:12A01:A10 |
| 687 | 10805 | Incyt10.F19.T3pINCY_367703 | I:3815547:12A01:C10 |

TABLE 15-continued

| SEQ ID NO | Spot Id | Sequence Name | Sample Name or Clone Name |
|---|---|---|---|
| 688 | 10815 | Incyte6.O20.T3pINCY__353709 | I:2881469:12A01:H10 |
| 689 | 10830 | 1438966 | I:1438966:10B01:G04 |
| 690 | 10832 | 2174773 | I:2174773:10B01:H04 |
| 691 | 10855 | 2555828 | I:2555828:04A01:D04 |
| 692 | 10864 | I1.P07.T3pINCY1__343616 | I:2966620:04B01:H04 |
| 693 | 10870 | I1.F19.T3pINCY1__343798 | I:2832889:04B01:C10 |
| 694 | 10873 | Incyt14.J19.T3pINCY__377361 | I:1342493:04A01:E10 |
| 695 | 10921 | 1675571 | I:1675571:08A02:E04 |
| 696 | 10924 | 1349433 | I:1349433:08B02:F04 |
| 697 | 10925 | 1819282 | I:1819282:08A02:G04 |
| 698 | 10936 | 1709017 | I:1709017:08B02:D10 |
| 699 | 10937 | 3121962 | I:3121962:08A02:E10 |
| 700 | 10938 | 3409027 | I:3409027:08B02:E10 |
| 701 | 10941 | 1697490 | I:1697490:08A02:G10 |
| 702 | 10961 | Incyt15.A19.T3pINCY__377748 | I:3176845:05A02:A10 |
| 703 | 10997 | Incyte3.E20.T3pINCY__352356 | I:3495906:07A02:C10 |
| 704 | 11035 | 1630804 | I:1630804:06A02:F10 |
| 705 | 11050 | Incyte6.I07.T3pINCY__353495 | I:2494284:11B02:E04 |
| 706 | 11053 | Incyte5.N08.T3pINCY__352941 | I:3316536:11A02:G04 |
| 707 | 11057 | Incyte5.B20.T3pINCY__353121 | I:3743802:11A02:A10 |
| 708 | 11092 | Incyt14.C20.T3pINCY__377370 | I:1690653:03B02:B10 |
| 709 | 11100 | Incyt14.K20.T3pINCY__377378 | I:1636553:03B02:F10 |
| 710 | 11104 | Incyt14.O20.T3pINCY__377382 | I:1402228:03B02:H10 |
| 711 | 11112 | Incyte8.H07.T3pINCY__354262 | I:2918558:01B02:D04 |
| 712 | 11114 | Incyt11.J08.T3pINCY__367915 | I:2837773:01B02:E04 |
| 713 | 11149 | Incyt10.N08.T3pINCY__367535 | I:4049957:12A02:G04 |
| 714 | 11153 | Incyt10.B20.T3pINCY__367715 | I:2182353:12A02:A10 |
| 715 | 11201 | 2579602 | I:2579602:04A02:A04 |
| 716 | 11202 | 2824181 | I:2824181:04B02:A04 |
| 717 | 11208 | 2842835 | I:2842835:04B02:D04 |
| 718 | 11221 | 1958560 | I:1958560:04A02:C10 |
| 719 | 11223 | I1.G20.T3pINCY1__343815 | I:1749417:04A02:D10 |
| 720 | 11231 | 2495131 | I:2495131:04A02:H10 |
| 721 | 11269 | 2133481 | I:2133481:08A01:C05 |
| 722 | 11290 | Incyte4.I21.T3pINCY__352760 | I:1340424:08B01:E11 |
| 723 | 11322 | 1858171 | I:1858171:05B01:E11 |
| 724 | 11335 | Incyte3.G09.T3pINCY__352182 | I:3360365:07A01:D05 |
| 725 | 11341 | Incyte3.M09.T3pINCY__352188 | I:1453445:07A01:G05 |
| 726 | 11347 | Incyte3.C21.T3pINCY__352370 | I:3334367:07A01:B11 |
| 727 | 11351 | Incyte3.G21.T3pINCY__352374 | I:3002566:07A01:D11 |
| 728 | 11380 | 1701809 | I:1701809:06B01:B11 |
| 729 | 11396 | Incyt10.C09.T3pINCY__367540 | I:2796468:11B01:B05 |
| 730 | 11463 | Incyt11.G10.T3pINCY__367944 | I:1486087:01A01:D05 |
| 731 | 11473 | Incyt11.A22.T3pINCY__368130 | I:2555034:01A01:A11 |
| 732 | 11485 | Incyt11.M22.T3pINCY__368142 | I:1402967:01A01:G11 |
| 733 | 11489 | Incyt10.B09.T3pINCY__367539 | I:2884153:12A01:A05 |
| 734 | 11493 | 2608167 | I:2608167:12A01:C05 |
| 735 | 11543 | Incyte4.H22.T3pINCY__352775 | I:2821541:10A01:D11 |
| 736 | 11568 | I1.P09.T3pINCY1__343648 | I:2883195:04B01:H05 |
| 737 | 11569 | Incyt14.B21.T3pINCY__377385 | I:1509602:04A01:A11 |
| 738 | 11583 | Incyt14.P21.T3pINCY__377399 | I:2832224:04A01:H11 |
| 739 | 11624 | 2343403 | I:2343403:08B02:D05 |
| 740 | 11639 | 1880426 | I:1880426:08A02:D11 |
| 741 | 11675 | 1511342 | I:1511342:05A02:F11 |
| 742 | 11677 | 1805745 | I:1805745:05A02:G11 |
| 743 | 11682 | 2707290 | I:2707290:07B02:A05 |
| 744 | 11683 | 3872557 | I:3872557:07A02:B05 |
| 745 | 11731 | Incyte2.C22.T3pINCY__352002 | I:1689068:06A02:B11 |
| 746 | 11736 | 3511355 | I:3511355:06B02:D11 |
| 747 | 11739 | Incyte2.K22.T3pINCY__352010 | I:1699587:06A02:F11 |
| 748 | 11745 | 3097582 | I:3097582:11A02:A05 |
| 749 | 11794 | Incyt14.A22.T3pINCY__377400 | I:2949427:03B02:A11 |
| 750 | 11806 | Incyt14.M22.T3pINCY__377412 | I:1525881:03B02:G11 |
| 751 | 11819 | 2158884 | I:2158884:01A02:F05 |
| 752 | 11835 | Incyt11.L21.T3pINCY__368125 | I:2183580:01A02:F11 |
| 753 | 11836 | Incyt11.L22.T3pINCY__368141 | I:1806769:01B02:F11 |
| 754 | 11855 | Incyt10.P10.T3pINCY__367569 | I:3856893:12A02:H05 |
| 755 | 11928 | Incyt14.H22.T3pINCY__377407 | I:1683944:04B02:D11 |
| 756 | 11934 | Incyt14.N22.T3pINCY__377413 | I:1907952:04B02:G11 |
| 757 | 11945 | Incyte7.I10.T3pINCY__353927 | I:1817352:02A02:E05 |
| 758 | 11992 | Incyte4.G23.T3pINCY__352790 | I:1683245:08B01:D12 |
| 759 | 12025 | 3176179 | I:3176179:05A01:E12 |
| 760 | 12035 | Incyte3.C11.T3pINCY__352210 | I:3175507:07A01:B06 |
| 761 | 12098 | 3553751 | I:3553751:11B01:A06 |
| 762 | 12187 | Incyt11.K24.T3pINCY__368172 | I:1504554:01A01:F12 |
| 763 | 12201 | Incyte6.I12.T3pINCY__353575 | I:2957410:12A01:E06 |

TABLE 15-continued

| SEQ ID NO | Spot Id | Sequence Name | Sample Name or Clone Name |
|---|---|---|---|
| 764 | 12253 | 1725001 | I:1725001:10A01:G12 |
| 765 | 12258 | I1.B11.T3pINCY1__343666 | I:2989991:04B01:A06 |
| 766 | 12259 | Incyt14.D11.T3pINCY__377227 | I:1514989:04A01:B06 |
| 767 | 12283 | Incyt14.L23.T3pINCY__377427 | I:1481225:04A01:F12 |
| 768 | 12295 | Incyte7.G11.T3pINCY__353941 | I:1624459:02A01:D06 |
| 769 | 12298 | Incyte7.J11.T3pINCY__353944 | I:2122820:02B01:E06 |
| 770 | 12329 | 2591352 | I:2591352:08A02:E06 |
| 771 | 12332 | 2551421 | I:2551421:08B02:F06 |
| 772 | 12369 | Incyt15.A23.T3pINCY__377812 | I:1252255:05A02:A12 |
| 773 | 12388 | 2674482 | I:2674482:07B02:B06 |
| 774 | 12446 | Incyte2.N24.T3pINCY__352045 | I:1634046:06B02:G12 |
| 775 | 12499 | Incyte9.C23.T3pINCY__354897 | I:2513883:03A02:B12 |
| 776 | 12515 | Incyt11.D11.T3pINCY__367957 | I:2537805:01A02:B06 |
| 777 | 12540 | Incyte8.L23.T3pINCY__354522 | I:1730527:01B02:F12 |
| 778 | 12544 | Incyt11.P24.T3pINCY__368177 | I:1733522:01B02:H12 |
| 779 | 12546 | 3948420 | I:3948420:12B01:A06 |
| 780 | 12548 | 3679736 | I:3679736:12B01:B06 |
| 781 | 12555 | Incyte6.L11.T3pINCY__353562 | I:4083705:12A02:F06 |
| 782 | 16846 | 772853 | I:772853:19A01:D07 |
| 783 | 16881 | 2028093 | I:2028093:15A01:E07 |
| 784 | 16883 | 2132508 | I:2132508:15A01:F07 |
| 785 | 16917 | Incyte20.I02.Alpha2__380275 | I:3144018:18B01:E01 |
| 786 | 16935 | Incyte20.K14.Alpha2__380469 | I:1967531:18B01:F07 |
| 787 | 16959 | 1426031 | I:1426031:14B01:B07 |
| 788 | 17017 | 1001970 | I:1001970:14A01:E07 |
| 789 | 17049 | K1.I14.Laf3__324935 | RG:160664:10006:E07 |
| 790 | 17090 | 341491 | I:341491:13B01:A01 |
| 791 | 17119 | 2058935 | I:2058935:13A01:H07 |
| 792 | 17122 | AA858434 | RG:1420946:10004:A01 |
| 793 | 17143 | R51346 | NIH50__39093 |
| 794 | 17236 | Incyte4.C14.T3pINCY__352642 | I:1602726:09B01:B07 |
| 795 | 17365 | 504786 | I:504786:14A02:C07 |
| 796 | 17370 | 2103752 | I:2103752:14B02:E07 |
| 797 | 17377 | K1.B01.Laf3__324720 | RG:197713:10007:A01 |
| 798 | 17379 | K1.D01.Laf3__324722 | RG:205212:10007:B01 |
| 799 | 17386 | AI523571 | RG:2117694:10016:E01 |
| 800 | 17395 | K1.D13.Laf3__324914 | RG:207395:10007:B07 |
| 801 | 17398 | AI421409 | RG:2097257:10016:C07 |
| 802 | 17422 | Incyte18.N01.Alpha2__379490 | I:349535:16B02:G01 |
| 803 | 17432 | Incyte18.H13.Alpha2__379676 | I:1965049:16B02:D07 |
| 804 | 17454 | 1995971 | I:1995971:13B02:G01 |
| 805 | 17457 | 2132815 | I:2132815:13A02:A07 |
| 806 | 17475 | N44546 | RG:272992:10008:B01 |
| 807 | 17479 | W03193 | RG:296383:10008:D01 |
| 808 | 17496 | H08652 | RG:45089:10005:D07 |
| 809 | 17511 | K1.H02.Laf3__324742 | RG:1409220:10013:D01 |
| 810 | 17524 | K2.C13.Laf3__325298 | RG:1705470:10015:B07 |
| 811 | 17603 | 1001730 | I:1001730:15A01:B02 |
| 812 | 17609 | 1922531 | I:1922531:15A01:E02 |
| 813 | 17618 | 707667 | I:707667:15B01:A08 |
| 814 | 17726 | 1997233 | I:1997233:14B01:G08 |
| 815 | 17730 | AA128438 | RG:526536:10002:A02 |
| 816 | 17746 | AA070046 | RG:530002:10002:A08 |
| 817 | 17756 | AA197021 | RG:608953:10002:F08 |
| 818 | 17793 | 2054420 | I:2054420:13A01:A02 |
| 819 | 17795 | 1994472 | I:1994472:13A01:B02 |
| 820 | 17851 | H13036 | NIH50__43563 |
| 821 | 17854 | R18972 | RG:33368:10004:G08 |
| 822 | 17867 | AA281116 | RG:711647:10010:F02 |
| 823 | 17878 | K1.E15.Laf3__324947 | RG:1047592:10012:C08 |
| 824 | 18006 | Incyte21.F16.Alpha2__380880 | I:2760114:19B02:C08 |
| 825 | 18062 | 2307314 | I:2307314:14B02:G02 |
| 826 | 18069 | 1981145 | I:1981145:14A02:C08 |
| 827 | 18097 | R99405 | RG:201268:10007:A08 |
| 828 | 18178 | R20998 | RG:36399:10005:A02 |
| 829 | 18187 | W24158 | RG:310019:10008:F02 |
| 830 | 18235 | AA923101 | RG:1521317:10013:F08 |
| 831 | 18305 | 743595 | I:743595:15A01:A03 |
| 832 | 18311 | 2621547 | I:2621547:15A01:D03 |
| 833 | 18314 | 1988412 | I:1988412:15B01:E03 |
| 834 | 18316 | 1987738 | I:1987738:15B01:F03 |
| 835 | 18321 | 1922944 | I:1922944:15A01:A09 |
| 836 | 18323 | 1213932 | I:1213932:15A01:B09 |
| 837 | 18362 | 2296027 | I:2296027:19B01:E09 |
| 838 | 18431 | 1998269 | I:1998269:14A01:H09 |
| 839 | 18445 | R85309 | RG:180296:10006:G03 |

TABLE 15-continued

| SEQ ID NO | Spot Id | Sequence Name | Sample Name or Clone Name |
|---|---|---|---|
| 840 | 18447 | H30045 | RG:190269:10006:H03 |
| 841 | 18454 | AA131155 | RG:587068:10002:C09 |
| 842 | 18460 | AA167493 | RG:609044:10002:F09 |
| 843 | 18464 | AA197125 | RG:629241:10002:H09 |
| 844 | 18471 | Incyte21.G06.Alpha2__380721 | I:1953051:16A01:D03 |
| 845 | 18473 | Incyte21.I06.Alpha2__380723 | I:518826:16A01:E03 |
| 846 | 18519 | 1997703 | I:1997703:13A01:D09 |
| 847 | 18560 | R14989 | RG:35716:10004:H09 |
| 848 | 18571 | K2.L05.Laf3__325179 | RG:712070:10010:F03 |
| 849 | 18594 | Incyte19.A06.Alpha2__379947 | I:1997779:17B01:A03 |
| 850 | 18620 | Incyte19.K18.Alpha2__380149 | I:1998428:17B01:F09 |
| 851 | 18624 | Incyte19.O18.Alpha2__380153 | I:406788:17B01:H09 |
| 852 | 18665 | 1968413 | I:1968413:15A02:E03 |
| 853 | 18683 | 552654 | I:552654:15A02:F09 |
| 854 | 18687 | 637576 | I:637576:15A02:H09 |
| 855 | 18693 | Incyte20.F06.Alpha2__380336 | I:606875:19A02:C03 |
| 856 | 18724 | 1962095 | I:1962095:18B02:B03 |
| 857 | 18758 | 856900 | I:856900:14B02:C03 |
| 858 | 18760 | 2132752 | I:2132752:14B02:D03 |
| 859 | 18769 | 143987 | I:143987:14A02:A09 |
| 860 | 18787 | K1.D05.Laf3__324786 | RG:206694:10007:B03 |
| 861 | 18797 | N23769 | RG:263708:10007:G03 |
| 862 | 18821 | Incyte18.E05.Alpha2__379545 | I:1461515:16A02:C03 |
| 863 | 18845 | Incyte18.M17.Alpha2__379745 | I:1425861:16A02:G09 |
| 864 | 18860 | 700559 | I:700559:13B02:F03 |
| 865 | 18872 | 1844755 | I:1844755:13B02:D09 |
| 866 | 18891 | W30991 | RG:310347:10008:F03 |
| 867 | 18894 | H19237 | RG:51009:10005:G03 |
| 868 | 18919 | K1.H06.Laf3__324806 | RG:1415437:10013:D03 |
| 869 | 18920 | K2.G05.Laf3__325174 | RG:1734353:10015:D03 |
| 870 | 18926 | AI281021 | RG:1872251:10015:G03 |
| 871 | 18937 | K1.J18.Laf3__325000 | RG:1476452:10013:E09 |
| 872 | 18942 | K2.M17.Laf3__325372 | RG:1895716:10015:G09 |
| 873 | 18988 | Incyte4.L05.T3pINCY__352507 | I:2069305:09B02:F03 |
| 874 | 19005 | 2674167 | I:2674167:09A02:G09 |
| 875 | 19025 | 2296518 | I:2296518:15A01:A10 |
| 876 | 19113 | 692827 | I:692827:14A01:E04 |
| 877 | 19130 | 1998594 | I:1998594:14B01:E10 |
| 878 | 19166 | AA186459 | RG:625691:10002:G10 |
| 879 | 19173 | Incyte21.E08.Alpha2__380751 | I:293495:16A01:C04 |
| 880 | 19183 | 3187911 | I:3187911:16A01:H04 |
| 881 | 19219 | 406016 | I:406016:13A01:B10 |
| 882 | 19227 | 671776 | I:671776:13A01:F10 |
| 883 | 19259 | H06516 | NIH50__44180 |
| 884 | 19287 | AA290719 | RG:700320:10010:D10 |
| 885 | 19348 | Incyte4.C20.T3pINCY__352738 | I:2556708:09B01:B10 |
| 886 | 19370 | 136571 | I:136571:15B02:E04 |
| 887 | 19376 | Incyte18.O08.Alpha2__379603 | I:1988674:15B02:H04 |
| 888 | 19389 | 556016 | I:556016:15A02:G10 |
| 889 | 19401 | 483757 | I:483757:19A02:E04 |
| 890 | 19444 | 1923893 | I:1923893:18B02:B10 |
| 891 | 19473 | 130254 | I:130254:14A02:A10 |
| 892 | 19482 | 2263936 | I:2263936:14B02:E10 |
| 893 | 19506 | AI335696 | RG:1949583:10016:A10 |
| 894 | 19512 | AI523861 | RG:2116699:10016:D10 |
| 895 | 19517 | K1.N19.Laf3__325020 | RG:266649:10007:G10 |
| 896 | 19527 | 996772 | I:996772:16A02:D04 |
| 897 | 19574 | 635178 | I:635178:13B02:C10 |
| 898 | 19600 | T83145 | RG:110764:10005:H04 |
| 899 | 19636 | K2.C19.Laf3__325394 | RG:1706414:10015:B10 |
| 900 | 19641 | K1.J20.Laf3__325032 | RG:1476433:10013:E10 |
| 901 | 19667 | Incyte19.C19.Alpha2__380157 | I:1368834:17A02:B10 |
| 902 | 19684 | Incyte4.D07.T3pINCY__352531 | I:2680168:09B02:B04 |
| 903 | 19701 | 1515905 | I:1515905:09A02:C10 |
| 904 | 19713 | 996104 | I:996104:15A01:A05 |
| 905 | 19725 | 1966446 | I:1966446:15A01:G05 |
| 906 | 19738 | 1999120 | I:1999120:15B01:E11 |
| 907 | 19743 | 591358 | I:591358:15A01:H11 |
| 908 | 19835 | 2055926 | I:2055926:14A01:F11 |
| 909 | 19887 | Incyte21.O10.Alpha2__380793 | I:452536:16A01:H05 |
| 910 | 19907 | 2056035 | I:2056035:13A01:B05 |
| 911 | 19922 | 2102320 | I:2102320:13B01:A11 |
| 912 | 19946 | R38438 | RG:26394:10004:E05 |
| 913 | 19955 | R42581 | NIH50__31143 |
| 914 | 19996 | AA745592 | RG:1283072:10012:F11 |
| 915 | 20084 | Incyte18.C22.Alpha2__379815 | I:79576:15B02:B11 |

TABLE 15-continued

| SEQ ID NO | Spot Id | Sequence Name | Sample Name or Clone Name |
|---|---|---|---|
| 916 | 20170 | 1431632 | I:1431632:14B02:E05 |
| 917 | 20171 | 234123 | I:234123:14A02:F05 |
| 918 | 20184 | 2027012 | I:2027012:14B02:D11 |
| 919 | 20185 | 128997 | I:128997:14A02:E11 |
| 920 | 20209 | K1.B21.Laf3__325040 | RG:204966:10007:A11 |
| 921 | 20212 | AI377014 | RG:2065950:10016:B11 |
| 922 | 20262 | 1995380 | I:1995380:13B02:C05 |
| 923 | 20302 | H19394 | RG:51505:10005:G05 |
| 924 | 20331 | K1.L10.Laf3__324874 | RG:1519327:10013:F05 |
| 925 | 20401 | 1824332 | I:1824332:09A02:A11 |
| 926 | 20422 | 735149 | I:735149:15B01:C06 |
| 927 | 20436 | 1530218 | I:1530218:15B01:B12 |
| 928 | 20508 | 1963854 | I:1963854:18B01:F12 |
| 929 | 20530 | 167371 | I:167371:14B01:A12 |
| 930 | 20551 | K1.G12.Laf3__324901 | RG:151093:10006:D06 |
| 931 | 20554 | AA143470 | RG:591811:10002:E06 |
| 932 | 20557 | R87294 | RG:180978:10006:G06 |
| 933 | 20558 | AA187806 | RG:624431:10002:G06 |
| 934 | 20570 | AA159912 | RG:593090:10002:E12 |
| 935 | 20587 | Incyte21.K12.Alpha2__380821 | I:2303180:16A01:F06 |
| 936 | 20617 | 911015 | I:911015:13A01:E06 |
| 937 | 20624 | 1968576 | I:1968576:13B01:H06 |
| 938 | 20676 | K1.C11.Laf3__324881 | RG:967302:10012:B06 |
| 939 | 20696 | AA627319 | RG:1157566:10012:D12 |
| 940 | 20714 | Incyte19.I12.Alpha2__380051 | I:1943853:17B01:E06 |
| 941 | 20716 | 1218621 | I:1218621:17B01:F06 |
| 942 | 20799 | 1967095 | I:1967095:15A02:H12 |
| 943 | 20878 | 998612 | I:998612:14B02:G06 |
| 944 | 20892 | 699410 | I:699410:14B02:F12 |
| 945 | 20937 | Incyte18.I11.Alpha2__379645 | I:429577:16A02:E06 |
| 946 | 20939 | Incyte18.K11.Alpha2__379647 | I:2117221:16A02:F06 |
| 947 | 20976 | 1782172 | I:1782172:13B02:H06 |
| 948 | 20986 | 1986809 | I:1986809:13B02:E12 |
| 949 | 20990 | 1986550 | I:1986550:13B02:G12 |
| 950 | 20999 | W07144 | RG:300017:10008:D06 |
| 951 | 21029 | AA890655 | RG:1405692:10013:C06 |
| 952 | 21035 | K1.L12.Laf3__324906 | RG:1519656:10013:F06 |
| 953 | 21038 | AI268327 | RG:1880845:10015:G06 |
| 954 | 21050 | K2.I23.Laf3__325464 | RG:1841029:10015:E12 |
| 955 | 21189 | RTA22200010F.e.10.1.P | M00056386D:H12 |
| 956 | 21212 | 1.L13.Beta5__309680 | M00056193B:C11 |
| 957 | 21214 | 1.N13.Beta5__309682 | M00056193B:D06 |
| 958 | 21234 | 4.B13.Beta5__310822 | M00054882C:C06 |
| 959 | 21245 | 4.M13.Beta5__310833 | M00054680B:D06 |
| 960 | 21290 | RTA00002690F.a.18.2.P | M00042437B:G03 |
| 961 | 21307 | RTA22200001F.g.08.1.P | M00042702D:B02 |
| 962 | 21339 | RTA22200011F.f.10.1.P | M00056569A:B12 |
| 963 | 21345 | W79308 | RG:346944:10009:A01 |
| 964 | 21349 | K2.E02.Laf3__325124 | RG:376801:10009:C01 |
| 965 | 21391 | RTA22200016F.o.05.1.P | M00057273B:H10 |
| 966 | 21407 | RTA22200017F.e.08.1.P | M00057336A:C12 |
| 967 | 21539 | 1.C02.Beta5__309495 | M00055932A:C02 |
| 968 | 21543 | 1.G02.Beta5__309499 | M00055935D:B06 |
| 969 | 21546 | 2.J01.Beta5__309870 | M00056908D:D08 |
| 970 | 21568 | 2.P13.Beta5__310068 | M00056952B:C08 |
| 971 | 21569 | 4.A02.Beta5__310645 | M00054728C:E03 |
| 972 | 21575 | 4.G02.Beta5__310651 | M00054730D:F06 |
| 973 | 21650 | RTA22200009F.o.15.1.P | M00042867B:F03 |
| 974 | 21654 | RTA22200009F.o.18.1.P | M00042868A:A06 |
| 975 | 21658 | RTA22200009F.p.01.1.P | M00042869D:B09 |
| 976 | 21660 | RTA22200009F.p.01.1.P | M00042869D:B09 |
| 977 | 21671 | 2.G01.Beta5__309867 | M00056719C:G03 |
| 978 | 21693 | 2.M13.Beta5__310065 | M00056785D:G01 |
| 979 | 21694 | AI251081 | RG:2007272:20003:G07 |
| 980 | 21701 | AI066797 | RG:1637588:10014:C01 |
| 981 | 21705 | AI123832 | RG:1651303:10014:E01 |
| 982 | 21735 | 3.G01.Beta5__310251 | M00043310D:E11 |
| 983 | 21766 | RTA22200025F.o.18.2.P | M00055398B:C07 |
| 984 | 21781 | RTA22200012F.a.23.1.P | M00056667C:H09 |
| 985 | 21786 | RTA22200026F.d.20.1.P | M00055423C:C03 |
| 986 | 21791 | 3.P14.Beta5__310468 | M00056669B:E07 |
| 987 | 21947 | 4.K15.Beta5__310863 | M00054684B:C07 |
| 988 | 21966 | 5.N03.Beta5__311058 | M00057194B:G12 |
| 989 | 22003 | RTA22200001F.g.22.1.P | M00042711B:G09 |
| 990 | 22040 | ovarian1.G15.amp3__326923 | RG:1862072:20001:D08 |
| 991 | 22071 | W87399 | RG:417093:10009:D08 |

TABLE 15-continued

| SEQ ID NO | Spot Id | Sequence Name | Sample Name or Clone Name |
|---|---|---|---|
| 992 | 22078 | K2.N16.Laf3__325357 | RG:809602:10011:G08 |
| 993 | 22132 | RTA22200022F.n.06.1.P | M00054980D:H02 |
| 994 | 22227 | AI252058 | RG:1983965:20002:B08 |
| 995 | 22279 | 4.G04.Beta5__310683 | M00054737D:F10 |
| 996 | 22291 | 4.C16.Beta5__310871 | M00054785D:G05 |
| 997 | 22299 | 4.K16.Beta5__310879 | M00054806B:G03 |
| 998 | 22352 | RTA22200009F.l.07.2.P | M00042842B:E02 |
| 999 | 22414 | AA595123 | RG:1102368:10003:G02 |
| 1000 | 22423 | AI040910 | RG:1647954:10014:D08 |
| 1001 | 22451 | RTA00002691F.d.11.3.P | M00043372B:B06 |
| 1002 | 22597 | RTA22200010F.h.09.1.P | M00056417A:F02 |
| 1003 | 22604 | 1.L05.Beta5__309552 | M00056150C:A10 |
| 1004 | 22608 | 1.P05.Beta5__309556 | M00056151C:A12 |
| 1005 | 22627 | RTA22200020F.j.04.1.P | M00054645B:C12 |
| 1006 | 22629 | 4.E05.Beta5__310697 | M00054646A:B10 |
| 1007 | 22632 | 4.H05.Beta5__310700 | M00054858D:F04 |
| 1008 | 22633 | RTA22200020F.j.09.1.P | M00054647A:A09 |
| 1009 | 22637 | RTA22200020F.j.11.1.P | M00054647D:E01 |
| 1010 | 22678 | 5.F17.Beta5__311274 | M00057231A:G04 |
| 1011 | 22697 | RTA22200001F.c.18.1.P | M00042551B:D12 |
| 1012 | 22698 | RTA22200009F.c.12.2.P | M00042513A:D03 |
| 1013 | 22703 | RTA22200001F.c.21.1.P | M00042551D:D12 |
| 1014 | 22710 | RTA22200009F.h.06.1.P | M00042803C:F11 |
| 1015 | 22714 | RTA22200009F.h.11.1.P | M00042805D:D12 |
| 1016 | 22715 | RTA22200001F.i.13.1.P | M00042731A:G04 |
| 1017 | 22729 | RTA22200011F.b.21.1.P | M00056537D:B06 |
| 1018 | 22775 | K2.G18.Laf3__325382 | RG:417109:10009:D09 |
| 1019 | 22848 | RTA22200022F.o.15.1.P | M00054995B:F02 |
| 1020 | 22896 | RTA22200007F.b.23.1.P | M00056151C:A12 |
| 1021 | 22931 | ovarian1.C18.amp3__326967 | RG:1983997:20002:B09 |
| 1022 | 22979 | 4.C06.Beta5__310711 | M00054744C:B02 |
| 1023 | 23050 | RTA22200009F.l.19.2.P | M00042845D:A12 |
| 1024 | 23053 | RTA22200001F.o.20.1.P | M00054800C:H10 |
| 1025 | 23097 | 2.I17.Beta5__310125 | M00056809B:A12 |
| 1026 | 23118 | AA595100 | RG:1102907:10003:G03 |
| 1027 | 23120 | AA640934 | RG:1173536:10003:H03 |
| 1028 | 23127 | AI027379 | RG:1650120:10014:D09 |
| 1029 | 23143 | RTA22200018F.j.04.1.P | M00043329D:E09 |
| 1030 | 23153 | RTA22200018F.p.12.1.P | M00043376A:G08 |
| 1031 | 23193 | RTA22200012F.c.07.1.P | M00056683B:F08 |
| 1032 | 23351 | 4.G19.Beta5__310923 | M00054700C:E02 |
| 1033 | 23407 | 1562.P22.gz43__208154 | M00042570C:H05 |
| 1034 | 23416 | RTA22200009F.i.02.2.P | M00042811B:A05 |
| 1035 | 23511 | 2.H20.Beta5__310172 | M00042457C:A05 |
| 1036 | 23513 | 2.J20.Beta5__310174 | M00042457C:A05 |
| 1037 | 23514 | RTA22200019F.k.01.1.P | M00054520A:D04 |
| 1038 | 23542 | RTA22200022F.p.04.1.P | M00055001A:B01 |
| 1039 | 23544 | RTA22200022F.p.07.1.P | M00055002B:G06 |
| 1040 | 23637 | AI251722 | RG:1984571:20002:C10 |
| 1041 | 23678 | 2.N19.Beta5__310162 | M00056964D:C08 |
| 1042 | 23689 | 4.I08.Beta5__310749 | M00054752A:E11 |
| 1043 | 23695 | 4.O08.Beta5__310755 | M00054760D:B10 |
| 1044 | 23743 | RTA22200016F.a.11.1.P | M00057156D:C12 |
| 1045 | 23755 | RTA22200001F.p.18.1.P | M00054917B:G02 |
| 1046 | 23758 | RTA22200009F.m.16.1.P | M00042850D:A06 |
| 1047 | 23765 | RTA22200002F.f.19.1.P | M00055468D:D05 |
| 1048 | 23770 | RTA22200010F.b.10.1.P | M00056360A:D09 |
| 1049 | 23772 | RTA22200010F.b.11.1.P | M00056360A:E07 |
| 1050 | 23776 | RTA22200010F.b.17.1.P | M00056362D:E05 |
| 1051 | 23784 | AI305307 | RG:1997021:20003:D04 |
| 1052 | 23798 | AI305997 | RG:1996788:20003:C10 |
| 1053 | 23813 | AI017336 | RG:1638979:10014:C04 |
| 1054 | 23816 | AA600197 | RG:949960:10003:D04 |
| 1055 | 23831 | AI027534 | RG:1650444:10014:D10 |
| 1056 | 23847 | 3.G07.Beta5__310347 | M00043350A:C04 |
| 1057 | 23875 | 3.D08.Beta5__310360 | M00056646D:G05 |
| 1058 | 23889 | RTA22200012F.c.19.1.P | M00056688C:E07 |
| 1059 | 24014 | 1.N09.Beta5__309618 | M00056175D:B05 |
| 1060 | 24033 | 4.A09.Beta5__310757 | M00054654A:F12 |
| 1061 | 24034 | 4.B09.Beta5__310758 | M00054868D:F12 |
| 1062 | 24064 | 4.P21.Beta5__310964 | M00054922B:B04 |
| 1063 | 24074 | 5.J09.Beta5__311150 | M00057211D:A03 |
| 1064 | 24094 | 5.N21.Beta5__311346 | M00057253A:C02 |
| 1065 | 24099 | RTA22200001F.e.17.1.P | M00042573B:A02 |
| 1066 | 24115 | RTA22200001F.k.19.1.P | M00042885C:A12 |
| 1067 | 24119 | RTA22200001F.k.23.1.P | M00042886D:H10 |

TABLE 15-continued

| SEQ ID NO | Spot Id | Sequence Name | Sample Name or Clone Name |
|---|---|---|---|
| 1068 | 24126 | RTA22200009F.i.21.2.P | M00042818D:A08 |
| 1069 | 24128 | RTA22200009F.i.22.2.P | M00042819A:C07 |
| 1070 | 24137 | RTA22200011F.d.18.1.P | M00056553C:E10 |
| 1071 | 24193 | 2.B10.Beta5__310006 | M00057302A:F08 |
| 1072 | 24209 | 2.B22.Beta5__310198 | M00042460B:A08 |
| 1073 | 24213 | 2.F22.Beta5__310202 | M00042516B:A08 |
| 1074 | 24222 | 3.M22.Beta5__310593 | M00054529C:G04 |
| 1075 | 24246 | RTA22200023F.a.09.1.P | M00055015C:H02 |
| 1076 | 24289 | 6.A10.Beta5__311541 | M00055204B:C04 |
| 1077 | 24315 | 6.K22.Beta5__311743 | M00055254C:E11 |
| 1078 | 24395 | 4.K10.Beta5__310783 | M00054765A:F10 |
| 1079 | 24450 | RTA22200009F.m.19.1.P | M00042851D:H04 |
| 1080 | 24452 | RTA22200009F.m.22.1.P | M00042853A:F01 |
| 1081 | 24457 | RTA22200002F.a.12.1.P | M00055426A:G06 |
| 1082 | 24464 | RTA22200009F.n.13.1.P | M00042857C:B11 |
| 1083 | 24466 | RTA22200010F.c.04.1.P | M00056365B:E08 |
| 1084 | 24467 | RTA22200002F.h.01.1.P | M00055496A:G12 |
| 1085 | 24472 | RTA22200010F.c.13.1.P | M00056369A:A06 |
| 1086 | 24479 | RTA22200002F.i.14.1.P | M00055510D:A08 |
| 1087 | 24483 | 2.C09.Beta5__309991 | M00056748C:B08 |
| 1088 | 24485 | 2.E09.Beta5__309993 | M00056749A:F01 |
| 1089 | 24490 | AI223486 | RG:2002551:20003:E05 |
| 1090 | 24510 | AI246847 | RG:2007337:20003:G11 |
| 1091 | 24525 | AI056508 | RG:1669553:10014:G05 |
| 1092 | 24549 | 3.E09.Beta5__310377 | M00043355B:F10 |
| 1093 | 24558 | 3.N09.Beta5__310386 | M00054557C:D09 |
| 1094 | 24559 | 3.O09.Beta5__310387 | M00043358B:G11 |
| 1095 | 24568 | 3.H21.Beta5__310572 | M00054596B:H09 |
| 1096 | 24587 | 3.L10.Beta5__310400 | M00056659A:D08 |
| 1097 | 24595 | RTA22200012F.e.05.1.P | M00056701B:A11 |
| 1098 | 24672 | RTA22200025F.o.13.2.P | M00055396C:E08 |
| 1099 | 24708 | 1.D11.Beta5__309640 | M00056180C:E06 |
| 1100 | 24740 | RTA22200022F.b.10.1.P | M00054876A:H08 |
| 1101 | 24754 | 4.B23.Beta5__310982 | M00054923C:D01 |
| 1102 | 24755 | 4.C23.Beta5__310983 | M00054725A:E09 |
| 1103 | 24762 | 4.J23.Beta5__310990 | M00054927A:H09 |
| 1104 | 24776 | 5.H11.Beta5__311180 | M00057216C:G01 |
| 1105 | 24792 | 5.H23.Beta5__311372 | M00057259B:B08 |
| 1106 | 24805 | RTA22200001F.f.13.1.P | M00042695D:D09 |
| 1107 | 24810 | RTA22200009F.e.15.1.P | M00042772D:F02 |
| 1108 | 24897 | 2.B12.Beta5__310038 | M00057310A:A07 |
| 1109 | 24930 | RTA22200022F.l.01.1.P | M00054961D:E08 |
| 1110 | 24960 | RTA22200023F.b.22.1.P | M00055027B:C11 |
| 1111 | 24996 | 6.D12.Beta5__311576 | M00056180C:E06 |
| 1112 | 25011 | RTA22200024F.o.16.1.P | M00055256D:B12 |
| 1113 | 25030 | AA230271 | RG:1007983:20004:C06 |
| 1114 | 25111 | 4.G24.Beta5__311003 | M00054831A:G04 |
| 1115 | 25156 | RTA22200009F.o.01.1.P | M00042862D:A12 |
| 1116 | 25158 | RTA22200009F.o.01.1.P | M00042862D:A12 |
| 1117 | 25177 | RTA22200002F.j.02.1.P | M00055514B:A05 |
| 1118 | 25191 | 2.G11.Beta5__310027 | M00056763B:A12 |
| 1119 | 25194 | AI223471 | RG:2002542:20003:E06 |
| 1120 | 25198 | AI251083 | RG:2007278:20003:G06 |
| 1121 | 25203 | 2.C23.Beta5__310215 | M00056822A:E08 |
| 1122 | 25205 | 2.E23.Beta5__310217 | M00056822C:G03 |
| 1123 | 25209 | 2.I23.Beta5__310221 | M00056823D:H02 |
| 1124 | 25217 | AI000585 | RG:1609994:10014:A06 |
| 1125 | 25226 | AA573799 | RG:1012852:10003:E06 |
| 1126 | 25236 | AA488335 | RG:842978:10003:B12 |
| 1127 | 25246 | AA643320 | RG:1172262:10003:G12 |
| 1128 | 25248 | AA858424 | RG:1420940:10003:H12 |
| 1129 | 25252 | 3.D11.Beta5__310408 | M00054558D:A01 |
| 1130 | 25261 | RTA22200018F.n.10.1.P | M00043363C:C05 |
| 1131 | 25273 | RTA22200019F.c.13.1.P | M00043407C:A05 |
| 1132 | 25274 | RTA22200020F.g.17.1.P | M00054621D:F07 |
| 1133 | 25286 | RTA22200026F.c.06.1.P | M00055413A:G12 |
| 1134 | 25288 | RTA22200026F.c.11.1.P | M00055414D:A09 |
| 1135 | 25290 | RTA22200026F.c.12.1.P | M00055414D:E01 |
| 1136 | 25301 | 3.F24.Beta5__310618 | M00056707B:C01 |
| 1137 | 25349 | Incyte5.G11.T3pINCY__352982 | I:3134070:10A02:D06 |
| 1138 | 25380 | Incyt14.F12.T3pINCY__377245 | I:2921194:04B02:C06 |
| 1139 | 25384 | Incyt14.J12.T3pINCY__377249 | I:2671453:04B02:E06 |
| 1140 | 25389 | I1.O12.T3pINCY1__343695 | I:1728607:04A02:H06 |
| 1141 | 25392 | Incyt14.B24.T3pINCY__377433 | I:2655513:04B02:A12 |
| 1142 | 25395 | I1.E24.T3pINCY1__343877 | I:1510349:04A02:C12 |
| 1143 | 25405 | I1.O24.T3pINCY1__343887 | I:2683114:04A02:H12 |

TABLE 15-continued

| SEQ ID NO | Spot Id | Sequence Name | Sample Name or Clone Name |
|---|---|---|---|
| 1144 | 25420 | 1518323 | I:1518323:02B02:G06 |
| 1145 | 25472 | 035JN007.A01.jet718__287634 | 035JN007.A01 |
| 1146 | 25481 | 7264.K01.Beta5__496302 | 035JN005.F01 |
| 1147 | 25482 | 7264.L01.Beta5__496303 | 035JN007.F01 |
| 1148 | 25491 | 7264.E13.Beta5__496488 | 035JN005.C07 |
| 1149 | 25510 | 035JN011.D01.jet718__288405 | 035JN011.D01 |
| 1150 | 25516 | 035JN011.G01.jet718__288408 | 035JN011.G01 |
| 1151 | 25519 | 035JN009.A07.jet718__288066 | 035JN009.A07 |
| 1152 | 25529 | 035JN009.F07.jet718__288071 | 035JN009.F07 |
| 1153 | 25541 | 035JN013.D01.SP6__315878 | 035JN013.D01 |
| 1154 | 25545 | 035JN013.F01.SP6__315880 | 035JN013.F01 |
| 1155 | 25551 | 035JN013.A07.SP6__315923 | 035JN013.A07 |
| 1156 | 25566 | 7815.P13.Beta5__497376 | 035JN015.H07 |
| 1157 | 25571 | 035JN017.C01.SP6__316549 | 035JN017.C01 |
| 1158 | 25593 | 035JN017.F07.SP6__316600 | 035JN017.F07 |
| 1159 | 25596 | 7559.N13.Beta5__511475 | 035JN019.G07 |
| 1160 | 25600 | 035JN023.A01.SP6__317123 | 035JN023.A01 |
| 1161 | 25601 | 035JN021.B01.SP6__316932 | 035JN021.B01 |
| 1162 | 25610 | 035JN023.F01.SP6__317128 | 035JN023.F01 |
| 1163 | 25612 | 035JN023.G01.SP6__317129 | 035JN023.G01 |
| 1164 | 25617 | 035JN021.B07.SP6__316980 | 035JN021.B07 |
| 1165 | 25621 | 035JN021.D07.SP6__316982 | 035JN021.D07 |
| 1166 | 25636 | 035JN027.C01.GZ43__334632 | 035Jn027.C01 |
| 1167 | 25643 | 035JN025.G01.GZ43__334444 | 035JN025.G01 |
| 1168 | 25647 | 035JN025.A07.GZ43__334486 | 035JN025.A07 |
| 1169 | 25648 | 035JN027.A07.GZ43__334678 | 035Jn027.A07 |
| 1170 | 25656 | 035JN027.E07.GZ43__334682 | 035Jn027.E07 |
| 1171 | 25660 | 035JN027.G07.GZ43__334684 | 035Jn027.G07 |
| 1172 | 25666 | 035JN031.B01.GZ43__406194 | 035Jn031.B01 |
| 1173 | 25668 | 7947.F01.Beta5__483642 | 035Jn031.C01 |
| 1174 | 25691 | 035JN029.G07.GZ43__334972 | 035JN029.G07 |
| 1175 | 25697 | 037XN001.B01.sp6__317640 | 037XN001.B01 |
| 1176 | 25715 | 037XN001.C07.sp6__317689 | 037XN001.C07 |
| 1177 | 25731 | 037XN005.C01.sp6__318121 | 037XN005.C01 |
| 1178 | 25736 | 037XN007.E01.sp6__318507 | 037XN007.E01 |
| 1179 | 25744 | 037XN007.A07.sp6__318551 | 037XN007.A07 |
| 1180 | 25745 | 037XN005.B07.sp6__318168 | 037XN005.B07 |
| 1181 | 25751 | 037XN005.E07.sp6__318171 | 037XN005.E07 |
| 1182 | 25752 | 037XN007.E07.sp6__318555 | 037XN007.E07 |
| 1183 | 25812 | 035JN004.C07.jet718__284263 | 035JN004.C07 |
| 1184 | 25822 | 035JN004.H07.jet718__284268 | 035JN004.H07 |
| 1185 | 25824 | 7264.B02.Beta5__496309 | 035JN008.A01 |
| 1186 | 25826 | 7264.D02.Beta5__496311 | 035JN008.B01 |
| 1187 | 25834 | 7264.L02.Beta5__496319 | 035JN008.F01 |
| 1188 | 25837 | 7264.O02.Beta5__496322 | 035JN006.H01 |
| 1189 | 25838 | 035JN008.H01.jet718__287833 | 035JN008.H01 |
| 1190 | 25843 | 7264.E14.Beta5__496504 | 035JN006.C07 |
| 1191 | 25844 | 7264.F14.Beta5__496505 | 035JN008.C07 |
| 1192 | 25849 | 035JN006.F07.jet718__287495 | 035JN006.F07 |
| 1193 | 25853 | 7264.O14.Beta5__496514 | 035JN006.H07 |
| 1194 | 25864 | 7569.J02.Beta5__497578 | 035JN012.E01 |
| 1195 | 25869 | 7569.O02.Beta5__497583 | 035JN010.H01 |
| 1196 | 25872 | 7569.B14.Beta5__497762 | 035JN012.A07 |
| 1197 | 25876 | 7569.F14.Beta5__497766 | 035JN012.C07 |
| 1198 | 25883 | 7569.M14.Beta5__497773 | 035JN010.G07 |
| 1199 | 25893 | 035JN014.D01.SP6__315974 | 035JN014.D01 |
| 1200 | 25897 | 7815.K02.Beta5__497195 | 035JN014.F01 |
| 1201 | 25898 | 035JN016.F01.SP6__316360 | 035JN016.F01 |
| 1202 | 25901 | 7815.O02.Beta5__497199 | 035JN014.H01 |
| 1203 | 25906 | 035JN016.B07.SP6__316404 | 035JN016.B07 |
| 1204 | 25908 | 035JN016.C07.SP6__316405 | 035JN016.C07 |
| 1205 | 25915 | 035JN014.G07.SP6__316025 | 035JN014.G07 |
| 1206 | 25919 | 7559.A02.Beta5__511286 | 035JN018.A01 |
| 1207 | 25920 | 035JN020.A01.SP6__316835 | 035JN020.A01 |
| 1208 | 25922 | 7559.D02.Beta5__511289 | 035JN020.B01 |
| 1209 | 25927 | 7559.I02.Beta5__511294 | 035JN018.E01 |
| 1210 | 25930 | 035JN020.F01.SP6__316840 | 035JN020.F01 |
| 1211 | 25931 | 7559.M02.Beta5__511298 | 035JN018.G01 |
| 1212 | 25933 | 7559.O02.Beta5__511300 | 035JN018.H01 |
| 1213 | 25936 | 7559.B14.Beta5__511479 | 035JN020.A07 |
| 1214 | 25938 | 035JN020.B07.SP6__316884 | 035JN020.B07 |
| 1215 | 25951 | 035JN022.A01.SP6__317027 | 035JN022.A01 |
| 1216 | 25953 | 035JN022.B01.SP6__317028 | 035JN022.B01 |
| 1217 | 25956 | 7852.F02.Beta5__510907 | 035JN024.C01 |
| 1218 | 25958 | 035JN024.D01.SP6__317222 | 035JN024.D01 |
| 1219 | 25960 | 7852.J02.Beta5__510911 | 035JN024.E01 |

TABLE 15-continued

| SEQ ID NO | Spot Id | Sequence Name | Sample Name or Clone Name |
|---|---|---|---|
| 1220 | 25967 | 035JN022.A07.SP6__317075 | 035JN022.A07 |
| 1221 | 25973 | 7852.G14.Beta5__511100 | 035JN022.D07 |
| 1222 | 25980 | 035JN024.G07.SP6__317273 | 035JN024.G07 |
| 1223 | 25983 | 035JN026.A01.GZ43__334534 | 035JN026.A01 |
| 1224 | 26000 | 035JN028.A07.GZ43__334870 | 035JN028.A07 |
| 1225 | 26001 | 035JN026.B07.GZ43__334583 | 035JN026.B07 |
| 1226 | 26009 | 035JN026.F07.GZ43__334587 | 035JN026.F07 |
| 1227 | 26010 | 7926.L14.Beta5__497004 | 035JN028.F07 |
| 1228 | 26014 | 035JN028.H07.GZ43__334877 | 035JN028.H07 |
| 1229 | 26019 | 035JN030.C01.GZ43__335035 | 035JN030.C01 |
| 1230 | 26024 | 035JN032.E01.GZ43__335229 | 035JN032.E01 |
| 1231 | 26033 | 035JN030.B07.GZ43__335082 | 035JN030.B07 |
| 1232 | 26040 | 035JN032.E07.GZ43__335277 | 035JN032.E07 |
| 1233 | 26042 | 035JN032.F07.GZ43__335278 | 035JN032.F07 |
| 1234 | 26049 | 037XN002.B01.sp6__317832 | 037XN002.B01 |
| 1235 | 26058 | 037XN004.F01.sp6__318028 | 037XN004.F01 |
| 1236 | 26059 | 037XN002.G01.sp6__317837 | 037XN002.G01 |
| 1237 | 26105 | 037XN006.F07.sp6__318460 | 037XN006.F07 |
| 1238 | 26109 | 037XN006.H07.sp6__318462 | 037XN006.H07 |
| 1239 | 26167 | 035JN001.E08.jet718__272145 | 035JN001.E08 |
| 1240 | 26177 | 035JN005.B02.jet718__284414 | 035JN005.B02 |
| 1241 | 26179 | 035JN005.C02.jet718__284415 | 035JN005.C02 |
| 1242 | 26182 | 7264.H03.Beta5__496331 | 035JN007.D02 |
| 1243 | 26187 | 035JN005.G02.jet718__284419 | 035JN005.G02 |
| 1244 | 26194 | 7264.D15.Beta5__496519 | 035JN007.B08 |
| 1245 | 26196 | 7264.F15.Beta5__496521 | 035JN007.C08 |
| 1246 | 26202 | 7264.L15.Beta5__496527 | 035JN007.F08 |
| 1247 | 26204 | 7264.N15.Beta5__496529 | 035JN007.G08 |
| 1248 | 26205 | 7264.O15.Beta5__496530 | 035JN005.H08 |
| 1249 | 26207 | 7569.A03.Beta5__497585 | 035JN009.A02 |
| 1250 | 26213 | 035JN009.D02.jet718__288029 | 035JN009.D02 |
| 1251 | 26221 | 7569.O03.Beta5__497599 | 035JN009.H02 |
| 1252 | 26228 | 035JN011.C08.jet718__288460 | 035JN011.C08 |
| 1253 | 26234 | 035JN011.F08.jet718__288463 | 035JN011.F08 |
| 1254 | 26238 | 035JN011.H08.jet718__288465 | 035JN011.H08 |
| 1255 | 26240 | 035JN015.A02.SP6__316075 | 035JN015.A02 |
| 1256 | 26264 | 035JN015.E08.SP6__316127 | 035JN015.E08 |
| 1257 | 26266 | 035JN015.F08.SP6__316128 | 035JN015.F08 |
| 1258 | 26269 | 035JN013.H08.SP6__315938 | 035JN013.H08 |
| 1259 | 26303 | 7852.A03.Beta5__510918 | 035JN021.A02 |
| 1260 | 26315 | 7852.M03.Beta5__510930 | 035JN021.G02 |
| 1261 | 26318 | 7852.P03.Beta5__510933 | 035JN023.H02 |
| 1262 | 26322 | 035JN023.B08.SP6__317180 | 035JN023.B08 |
| 1263 | 26329 | 7852.K15.Beta5__511120 | 035JN021.F08 |
| 1264 | 26347 | 035JN025.G02.GZ43__334452 | 035JN025.G02 |
| 1265 | 26358 | 035JN027.D08.GZ43__334689 | 035Jn027.D08 |
| 1266 | 26364 | 035JN027.G08.GZ43__334692 | 035Jn027.G08 |
| 1267 | 26365 | 035JN025.H08.GZ43__334501 | 035JN025.H08 |
| 1268 | 26369 | 035JN029.B02.GZ43__334927 | 035JN029.B02 |
| 1269 | 26371 | 035JN029.C02.GZ43__334928 | 035JN029.C02 |
| 1270 | 26378 | 035JN031.F02.GZ43__406206 | 035Jn031.F02 |
| 1271 | 26384 | 035JN031.A08.GZ43__406249 | 035Jn031.A08 |
| 1272 | 26387 | 035JN029.C08.GZ43__334976 | 035JN029.C08 |
| 1273 | 26389 | 035JN029.D08.GZ43__334977 | 035JN029.D08 |
| 1274 | 26396 | 7947.N15.Beta5__483874 | 035Jn031.G08 |
| 1275 | 26415 | 037XN001.A08.sp6__317695 | 037XN001.A08 |
| 1276 | 26422 | 037XN003.D08.sp6__317986 | 037XN003.D08 |
| 1277 | 26425 | 037XN001.F08.sp6__317700 | 037XN001.F08 |
| 1278 | 26433 | 037XN005.B02.sp6__318128 | 037XN005.B02 |
| 1279 | 26496 | 035JN004.A02.jet718__284221 | 035JN004.A02 |
| 1280 | 26500 | 035JN004.C02.jet718__284223 | 035JN004.C02 |
| 1281 | 26515 | 035JN002.C08.jet718__283887 | 035JN002.C08 |
| 1282 | 26517 | 035JN002.D08.jet718__283888 | 035JN002.D08 |
| 1283 | 26522 | 035JN004.F08.jet718__284274 | 035JN004.F08 |
| 1284 | 26529 | 7264.C04.Beta5__496342 | 035JN006.B02 |
| 1285 | 26531 | 7264.E04.Beta5__496344 | 035JN006.C02 |
| 1286 | 26542 | 035JN008.H02.jet718__287841 | 035JN008.H02 |
| 1287 | 26550 | 035JN008.D08.jet718__287885 | 035JN008.D08 |
| 1288 | 26552 | 035JN008.E08.jet718__287886 | 035JN008.E08 |
| 1289 | 26555 | 7264.M16.Beta5__496544 | 035JN006.G08 |
| 1290 | 26564 | 035JN012.C02.jet718__288604 | 035JN012.C02 |
| 1291 | 26565 | 035JN010.D02.jet718__288221 | 035JN010.D02 |
| 1292 | 26574 | 7569.P04.Beta5__497616 | 035JN012.H02 |
| 1293 | 26579 | 7569.E16.Beta5__497797 | 035JN010.C08 |
| 1294 | 26581 | 7569.G16.Beta5__497799 | 035JN010.D08 |
| 1295 | 26588 | 7569.N16.Beta5__497806 | 035JN012.G08 |

TABLE 15-continued

| SEQ ID NO | Spot Id | Sequence Name | Sample Name or Clone Name |
|---|---|---|---|
| 1296 | 26590 | 7569.P16.Beta5__497808 | 035JN012.H08 |
| 1297 | 26595 | 035JN014.C02.SP6__315981 | 035JN014.C02 |
| 1298 | 26604 | 035JN016.G02.SP6__316369 | 035JN016.G02 |
| 1299 | 26617 | 035JN014.F08.SP6__316032 | 035JN014.F08 |
| 1300 | 26618 | 035JN016.F08.SP6__316416 | 035JN016.F08 |
| 1301 | 26632 | 035JN020.E02.SP6__316847 | 035JN020.E02 |
| 1302 | 26636 | 035JN020.G02.SP6__316849 | 035JN020.G02 |
| 1303 | 26641 | 035JN018.B08.SP6__316700 | 035JN018.B08 |
| 1304 | 26643 | 035JN018.C08.SP6__316701 | 035JN018.C08 |
| 1305 | 26654 | 035JN020.H08.SP6__316898 | 035JN020.H08 |
| 1306 | 26670 | 7852.P04.Beta5__510949 | 035JN024.H02 |
| 1307 | 26676 | 7852.F16.Beta5__511131 | 035JN024.C08 |
| 1308 | 26690 | 035JN028.B02.GZ43__334831 | 035JN028.B02 |
| 1309 | 26691 | 035JN026.C02.GZ43__334544 | 035JN026.C02 |
| 1310 | 26694 | 035JN028.D02.GZ43__334833 | 035JN028.D02 |
| 1311 | 26696 | 035JN028.E02.GZ43__334834 | 035JN028.E02 |
| 1312 | 26714 | 035JN028.F08.GZ43__334883 | 035JN028.F08 |
| 1313 | 26719 | 035JN030.A02.GZ43__335041 | 035JN030.A02 |
| 1314 | 26723 | 035JN030.C02.GZ43__335043 | 035JN030.C02 |
| 1315 | 26732 | 035JN032.G02.GZ43__335239 | 035JN032.G02 |
| 1316 | 26741 | 035JN030.D08.GZ43__335092 | 035JN030.D08 |
| 1317 | 26742 | 7947.H16.Beta5__483884 | 035JN032.D08 |
| 1318 | 26760 | 037XN004.E02.sp6__318035 | 037XN004.E02 |
| 1319 | 26765 | 037XN002.H02.sp6__317846 | 037XN002.H02 |
| 1320 | 26771 | 037XN002.C08.sp6__317889 | 037XN002.C08 |
| 1321 | 26791 | 037XN006.E02.sp6__318419 | 037XN006.E02 |
| 1322 | 26801 | 037XN006.B08.sp6__318464 | 037XN006.B08 |
| 1323 | 26803 | 037XN006.C08.sp6__318465 | 037XN006.C08 |
| 1324 | 26809 | 037XN006.F08.sp6__318468 | 037XN006.F08 |
| 1325 | 26882 | 7264.D05.Beta5__496359 | 035JN007.B03 |
| 1326 | 26884 | 7264.F05.Beta5__496361 | 035JN007.C03 |
| 1327 | 26889 | 7264.K05.Beta5__496366 | 035JN005.F03 |
| 1328 | 26895 | 7264.A17.Beta5__496548 | 035JN005.A09 |
| 1329 | 26906 | 7264.L17.Beta5__496559 | 035JN007.F09 |
| 1330 | 26909 | 035JN005.H09.jet718__284476 | 035JN005.H09 |
| 1331 | 26918 | 035JN011.D03.jet718__288421 | 035JN011.D03 |
| 1332 | 26922 | 035JN011.F03.jet718__288423 | 035JN011.F03 |
| 1333 | 26924 | 7569.N05.Beta5__497630 | 035JN011.G03 |
| 1334 | 26939 | 035JN009.G09.jet718__288088 | 035JN009.G09 |
| 1335 | 26942 | 035JN011.H09.jet718__288473 | 035JN011.H09 |
| 1336 | 26948 | 035JN015.C03.SP6__316085 | 035JN015.C03 |
| 1337 | 26953 | 035JN013.F03.SP6__315896 | 035JN013.F03 |
| 1338 | 26958 | 035JN015.H03.SP6__316090 | 035JN015.H03 |
| 1339 | 26966 | 035JN015.D09.SP6__316134 | 035JN015.D09 |
| 1340 | 26970 | 035JN015.F09.SP6__316136 | 035JN015.F09 |
| 1341 | 26974 | 035JN015.H09.SP6__316138 | 035JN015.H09 |
| 1342 | 26979 | 7559.E05.Beta5__511338 | 035JN017.C03 |
| 1343 | 26995 | 035JN017.C09.SP6__316613 | 035JN017.C09 |
| 1344 | 27000 | 035JN019.E09.SP6__316807 | 035JN019.E09 |
| 1345 | 27012 | 035JN023.C03.sp6__317141 | 035JN023.C03 |
| 1346 | 27017 | 035JN021.F03.sp6__316952 | 035JN021.F03 |
| 1347 | 27019 | 035JN021.G03.sp6__316953 | 035JN021.G03 |
| 1348 | 27037 | 7852.O17.Beta5__511156 | 035JN021.H09 |
| 1349 | 27041 | 035JN025.B03.GZ43__334455 | 035JN025.B03 |
| 1350 | 27043 | 035JN025.C03.GZ43__334456 | 035JN025.C03 |
| 1351 | 27045 | 035JN025.D03.GZ43__334457 | 035JN025.D03 |
| 1352 | 27046 | 035JN027.D03.GZ43__334649 | 035Jn027.D03 |
| 1353 | 27050 | 035JN027.F03.GZ43__334651 | 035Jn027.F03 |
| 1354 | 27061 | 035JN025.D09.GZ43__334505 | 035JN025.D09 |
| 1355 | 27070 | 035JN027.H09.GZ43__334701 | 035Jn027.H09 |
| 1356 | 27083 | 035JN029.G03.GZ43__334940 | 035JN029.G03 |
| 1357 | 27089 | 035JN029.B09.GZ43__334983 | 035JN029.B09 |
| 1358 | 27091 | 035JN029.C09.GZ43__334984 | 035JN029.C09 |
| 1359 | 27093 | 035JN029.D09.GZ43__334985 | 035JN029.D09 |
| 1360 | 27095 | 035JN029.E09.GZ43__334986 | 035JN029.E09 |
| 1361 | 27096 | 035JN031.E09.GZ43__406261 | 035Jn031.E09 |
| 1362 | 27098 | 7947.L17.Beta5__483904 | 035Jn031.F09 |
| 1363 | 27109 | 037XN001.D03.sp6__317658 | 037XN001.D03 |
| 1364 | 27113 | 037XN001.F03.sp6__317660 | 037XN001.F03 |
| 1365 | 27114 | 037XN003.F03.sp6__317948 | 037XN003.F03 |
| 1366 | 27123 | 037XN001.C09.sp6__317705 | 037XN001.C09 |
| 1367 | 27133 | 037XN001.H09.sp6__317710 | 037XN001.H09 |
| 1368 | 27148 | 037XN007.G03.sp6__318525 | 037XN007.G03 |
| 1369 | 27158 | 037XN007.D09.sp6__318570 | 037XN007.D09 |
| 1370 | 27205 | 035JN002.D03.jet718__283848 | 035JN002.D03 |
| 1371 | 27221 | 035JN002.D09.jet718__283896 | 035JN002.D09 |

TABLE 15-continued

| SEQ ID NO | Spot Id | Sequence Name | Sample Name or Clone Name |
|---|---|---|---|
| 1372 | 27244 | 035JN008.G03.jet718__287848 | 035JN008.G03 |
| 1373 | 27249 | 035JN006.B09.jet718__287507 | 035JN006.B09 |
| 1374 | 27268 | 7569.F06.Beta5__497638 | 035JN012.C03 |
| 1375 | 27269 | 7569.G06.Beta5__497639 | 035JN010.D03 |
| 1376 | 27275 | 7569.M06.Beta5__497645 | 035JN010.G03 |
| 1377 | 27298 | 035JN016.B03.SP6__316372 | 035JN016.B03 |
| 1378 | 27306 | 035JN016.F03.SP6__316376 | 035JN016.F03 |
| 1379 | 27316 | 7815.F18.Beta5__497446 | 035JN016.C09 |
| 1380 | 27318 | 035JN016.D09.SP6__316422 | 035JN016.D09 |
| 1381 | 27323 | 035JN014.G09.SP6__316041 | 035JN014.G09 |
| 1382 | 27331 | 035JN018.C03.SP6__316661 | 035JN018.C03 |
| 1383 | 27336 | 035JN020.E03.SP6__316855 | 035JN020.E03 |
| 1384 | 27344 | 035JN020.A09.SP6__316899 | 035JN020.A09 |
| 1385 | 27350 | 035JN020.D09.SP6__316902 | 035JN020.D09 |
| 1386 | 27366 | 035JN024.D03.SP6__317238 | 035JN024.D03 |
| 1387 | 27368 | 035JN024.E03.SP6__317239 | 035JN024.E03 |
| 1388 | 27369 | 035JN022.F03.SP6__317048 | 035JN022.F03 |
| 1389 | 27378 | 035JN024.B09.SP6__317284 | 035JN024.B09 |
| 1390 | 27386 | 035JN024.F09.SP6__317288 | 035JN024.F09 |
| 1391 | 27389 | 7852.O18.Beta5__511172 | 035JN022.H09 |
| 1392 | 27406 | 035JN028.H03.GZ43__334845 | 035JN028.H03 |
| 1393 | 27427 | 035JN030.C03.GZ43__335051 | 035JN030.C03 |
| 1394 | 27431 | 035JN030.E03.GZ43__335053 | 035JN030.E03 |
| 1395 | 27433 | 035JN030.F03.GZ43__335054 | 035JN030.F03 |
| 1396 | 27435 | 035JN030.G03.GZ43__335055 | 035JN030.G03 |
| 1397 | 27450 | 035JN032.F09.GZ43__335294 | 035JN032.F09 |
| 1398 | 27451 | 035JN030.G09.GZ43__335103 | 035JN030.G09 |
| 1399 | 27453 | 035JN030.H09.GZ43__335104 | 035JN030.H09 |
| 1400 | 27517 | 037XN006.H09.sp6__318478 | 037XN006.H09 |
| 1401 | 27574 | 035JN003.D10.jet718__284096 | 035JN003.D10 |
| 1402 | 27576 | 035JN003.E10.jet718__284097 | 035JN003.E10 |
| 1403 | 27581 | 035JN001.H10.jet718__272164 | 035JN001.H10 |
| 1404 | 27586 | 7264.D07.Beta5__496391 | 035JN007.B04 |
| 1405 | 27599 | 035JN005.A10.jet718__284477 | 035JN005.A10 |
| 1406 | 27603 | 7264.E19.Beta5__496584 | 035JN005.C10 |
| 1407 | 27612 | 035JN007.G10.jet718__287712 | 035JN007.G10 |
| 1408 | 27616 | 035JN011.A04.jet718__288426 | 035JN011.A04 |
| 1409 | 27634 | 035JN011.B10.jet718__288475 | 035JN011.B10 |
| 1410 | 27640 | 035JN011.E10.jet718__288478 | 035JN011.E10 |
| 1411 | 27654 | 035JN015.D04.SP6__316094 | 035JN015.D04 |
| 1412 | 27666 | 035JN015.B10.SP6__316140 | 035JN015.B10 |
| 1413 | 27674 | 7815.L19.Beta5__497468 | 035JN015.F10 |
| 1414 | 27676 | 7815.N19.Beta5__497470 | 035JN015.G10 |
| 1415 | 27677 | 035JN013.H10.SP6__315954 | 035JN013.H10 |
| 1416 | 27699 | 7559.E19.Beta5__511562 | 035JN017.C10 |
| 1417 | 27705 | 035JN017.F10.SP6__316624 | 035JN017.F10 |
| 1418 | 27719 | 035JN021.E04.SP6__316959 | 035JN021.E04 |
| 1419 | 27721 | 035JN021.F04.SP6__316960 | 035JN021.F04 |
| 1420 | 27722 | 035JN023.F04.SP6__317152 | 035JN023.F04 |
| 1421 | 27726 | 035JN023.H04.SP6__317154 | 035JN023.H04 |
| 1422 | 27732 | 035JN023.C10.SP6__317197 | 035JN023.C10 |
| 1423 | 27735 | 035JN021.E10.SP6__317007 | 035JN021.E10 |
| 1424 | 27752 | 035JN027.E04.GZ43__334658 | 035Jn027.E04 |
| 1425 | 27753 | 035JN025.F04.GZ43__334467 | 035JN025.F04 |
| 1426 | 27754 | 035JN027.F04.GZ43__334659 | 035Jn027.F04 |
| 1427 | 27767 | 035JN025.E10.GZ43__334514 | 035JN025.E10 |
| 1428 | 27773 | 035JN025.H10.GZ43__334517 | 035JN025.H10 |
| 1429 | 27793 | 035JN029.B10.GZ43__334991 | 035JN029.B10 |
| 1430 | 27794 | 7947.D19.Beta5__483928 | 035Jn031.B10 |
| 1431 | 27799 | 035JN029.E10.GZ43__334994 | 035JN029.E10 |
| 1432 | 27801 | 035JN029.F10.GZ43__334995 | 035JN029.F10 |
| 1433 | 27831 | 037XN001.E10.sp6__317715 | 037XN001.E10 |
| 1434 | 27919 | 035JN002.A10.jet718__283901 | 035JN002.A10 |
| 1435 | 27932 | 035JN004.G10.jet718__284291 | 035JN004.G10 |
| 1436 | 27935 | 7264.A08.Beta5__496404 | 035JN006.A04 |
| 1437 | 27939 | 7264.E08.Beta5__496408 | 035JN006.C04 |
| 1438 | 27943 | 035JN006.E04.jet718__287470 | 035JN006.E04 |
| 1439 | 27948 | 035JN008.G04.jet718__287856 | 035JN008.G04 |
| 1440 | 27952 | 035JN008.A10.jet718__287898 | 035JN008.A10 |
| 1441 | 27979 | 7569.M08.Beta5__497677 | 035JN010.G04 |
| 1442 | 27984 | 035JN012.A10.jet718__288666 | 035JN012.A10 |
| 1443 | 27990 | 7569.H20.Beta5__497864 | 035JN012.D10 |
| 1444 | 27992 | 035JN012.E10.jet718__288670 | 035JN012.E10 |
| 1445 | 28002 | 035JN016.B04.SP6__316380 | 035JN016.B04 |
| 1446 | 28021 | 035JN014.D10.SP6__316046 | 035JN014.D10 |
| 1447 | 28040 | 035JN020.E04.SP6__316863 | 035JN020.E04 |

TABLE 15-continued

| SEQ ID NO | Spot Id | Sequence Name | Sample Name or Clone Name |
|---|---|---|---|
| 1448 | 28048 | 7559.B20.Beta5__511575 | 035JN020.A10 |
| 1449 | 28076 | 035JN024.G04.SP6__317249 | 035JN024.G04 |
| 1450 | 28085 | 035JN022.D10.SP6__317102 | 035JN022.D10 |
| 1451 | 28106 | 7926.L08.Beta5__496908 | 035JN028.F04 |
| 1452 | 28108 | 035JN028.G04.GZ43__334852 | 035JN028.G04 |
| 1453 | 28115 | 7926.E20.Beta5__497093 | 035JN026.C10 |
| 1454 | 28116 | 035JN028.C10.GZ43__334896 | 035JN028.C10 |
| 1455 | 28122 | 035JN028.F10.GZ43__334899 | 035JN028.F10 |
| 1456 | 28125 | 035JN026.H10.GZ43__334613 | 035JN026.H10 |
| 1457 | 28130 | 035JN032.B04.GZ43__335250 | 035JN032.B04 |
| 1458 | 28138 | 035JN032.F04.GZ43__335254 | 035JN032.F04 |
| 1459 | 28139 | 035JN030.G04.GZ43__335063 | 035JN030.G04 |
| 1460 | 28147 | 035JN030.C10.GZ43__335107 | 035JN030.C10 |
| 1461 | 28167 | 037XN002.E04.sp6__317859 | 037XN002.E04 |
| 1462 | 28189 | 037XN002.H10.sp6__317910 | 037XN002.H10 |
| 1463 | 28213 | 037XN006.D10.sp6__318482 | 037XN006.D10 |
| 1464 | 28215 | 037XN006.E10.sp6__318483 | 037XN006.E10 |
| 1465 | 28219 | 037XN006.G10.sp6__318485 | 037XN006.G10 |
| 1466 | 28222 | 037XN008.H10.sp6__318678 | 037XN008.H10 |
| 1467 | 28284 | 035JN003.G11.jet718__284107 | 035JN003.G11 |
| 1468 | 28289 | 035JN005.B05.jet718__284438 | 035JN005.B05 |
| 1469 | 28290 | 7264.D09.Beta5__496423 | 035JN007.B05 |
| 1470 | 28291 | 035JN005.C05.jet718__284439 | 035JN005.C05 |
| 1471 | 28292 | 7264.F09.Beta5__496425 | 035JN007.C05 |
| 1472 | 28299 | 7264.M09.Beta5__496432 | 035JN005.G05 |
| 1473 | 28325 | 035JN009.D05.jet718__288053 | 035JN009.D05 |
| 1474 | 28330 | 7569.L09.Beta5__497692 | 035JN011.F05 |
| 1475 | 28341 | 035JN009.D11.jet718__288101 | 035JN009.D11 |
| 1476 | 28382 | 7815.P21.Beta5__497504 | 035JN015.H11 |
| 1477 | 28384 | 7559.B09.Beta5__511399 | 035JN019.A05 |
| 1478 | 28397 | 035JN017.H05.SP6__316586 | 035JN017.H05 |
| 1479 | 28399 | 7559.A21.Beta5__511590 | 035JN017.A11 |
| 1480 | 28409 | 035JN017.F11.SP6__316632 | 035JN017.F11 |
| 1481 | 28413 | 035JN017.H11.SP6__316634 | 035JN017.H11 |
| 1482 | 28416 | 035JN023.A05.SP6__317155 | 035JN023.A05 |
| 1483 | 28437 | 7852.G21.Beta5__511212 | 035JN021.D11 |
| 1484 | 28439 | 035JN021.E11.SP6__317015 | 035JN021.E11 |
| 1485 | 28444 | 7852.N21.Beta5__511219 | 035JN023.G11 |
| 1486 | 28469 | 035JN025.D11.GZ43__334521 | 035JN025.D11 |
| 1487 | 28475 | 7926.M21.Beta5__497117 | 035JN025.G11 |
| 1488 | 28485 | 035JN029.D05.GZ43__334953 | 035JN029.D05 |
| 1489 | 28492 | 7947.N09.Beta5__483778 | 035Jn031.G05 |
| 1490 | 28503 | 035JN029.E11.GZ43__335002 | 035JN029.E11 |
| 1491 | 28506 | 7947.L21.Beta5__483968 | 035Jn031.F11 |
| 1492 | 28507 | 035JN029.G11.GZ43__335004 | 035JN029.G11 |
| 1493 | 28523 | 037XN001.G05.sp6__317677 | 037XN001.G05 |
| 1494 | 28546 | 037XN007.B05.sp6__318536 | 037XN007.B05 |
| 1495 | 28562 | 037XN007.B11.sp6__318584 | 037XN007.B11 |
| 1496 | 28569 | 037XN005.F11.sp6__318204 | 037XN005.F11 |
| 1497 | 28607 | 035JN002.A05.jet718__283861 | 035JN002.A05 |
| 1498 | 28608 | 035JN004.A05.jet718__284245 | 035JN004.A05 |
| 1499 | 28615 | 035JN002.E05.jet718__283865 | 035JN002.E05 |
| 1500 | 28625 | 035JN002.B11.jet718__283910 | 035JN002.B11 |
| 1501 | 28629 | 035JN002.D11.jet718__283912 | 035JN002.D11 |
| 1502 | 28631 | 035JN002.E11.jet718__283913 | 035JN002.E11 |
| 1503 | 28632 | 035JN004.E11.jet718__284297 | 035JN004.E11 |
| 1504 | 28650 | 035JN008.F05.jet718__287863 | 035JN008.F05 |
| 1505 | 28669 | 035JN006.H11.jet718__287529 | 035JN006.H11 |
| 1506 | 28670 | 035JN008.H11.jet718__287913 | 035JN008.H11 |
| 1507 | 28683 | 035JN010.G05.jet718__288248 | 035JN010.G05 |
| 1508 | 28693 | 035JN010.D11.jet718__288293 | 035JN010.D11 |
| 1509 | 28696 | 035JN012.E11.jet718__288678 | 035JN012.E11 |
| 1510 | 28706 | 035JN016.B05.SP6__316388 | 035JN016.B05 |
| 1511 | 28737 | 035JN018.B05.SP6__316676 | 035JN018.B05 |
| 1512 | 28738 | 7559.D10.Beta5__511417 | 035JN020.B05 |
| 1513 | 28743 | 035JN018.E05.SP6__316679 | 035JN018.E05 |
| 1514 | 28754 | 7559.D22.Beta5__511609 | 035JN020.B11 |
| 1515 | 28773 | 035JN022.D05.SP6__317062 | 035JN022.D05 |
| 1516 | 28774 | 7852.H10.Beta5__511037 | 035JN024.D05 |
| 1517 | 28787 | 7852.E22.Beta5__511226 | 035JN022.C11 |
| 1518 | 28799 | 035JN026.A05.GZ43__334566 | 035JN026.A05 |
| 1519 | 28800 | 035JN028.A05.GZ43__334854 | 035JN028.A05 |
| 1520 | 28802 | 035JN028.B05.GZ43__334855 | 035JN028.B05 |
| 1521 | 28813 | 035JN026.H05.GZ43__334573 | 035JN026.H05 |
| 1522 | 28827 | 035JN026.G11.GZ43__334620 | 035JN026.G11 |
| 1523 | 28829 | 035JN026.H11.GZ43__334621 | 035JN026.H11 |

TABLE 15-continued

| SEQ ID NO | Spot Id | Sequence Name | Sample Name or Clone Name |
|---|---|---|---|
| 1524 | 28830 | 035JN028.H11.GZ43__334909 | 035JN028.H11 |
| 1525 | 28838 | 035JN032.D05.GZ43__335260 | 035JN032.D05 |
| 1526 | 28840 | 035JN032.E05.GZ43__335261 | 035JN032.E05 |
| 1527 | 28842 | 035JN032.F05.GZ43__335262 | 035JN032.F05 |
| 1528 | 28847 | 035JN030.A11.GZ43__335113 | 035JN030.A11 |
| 1529 | 28849 | 035JN030.B11.GZ43__335114 | 035JN030.B11 |
| 1530 | 28853 | 035JN030.D11.GZ43__335116 | 035JN030.D11 |
| 1531 | 28858 | 035JN032.F11.GZ43__335310 | 035JN032.F11 |
| 1532 | 28863 | 037XN002.A05.sp6__317863 | 037XN002.A05 |
| 1533 | 28881 | 037XN002.B11.sp6__317912 | 037XN002.B11 |
| 1534 | 28890 | 037XN004.F11.sp6__318108 | 037XN004.F11 |
| 1535 | 28899 | 037XN006.C05.sp6__318441 | 037XN006.C05 |
| 1536 | 28911 | 037XN006.A11.sp6__318487 | 037XN006.A11 |
| 1537 | 28961 | 035JN001.B06.jet718__272126 | 035JN001.B06 |
| 1538 | 28996 | 035JN007.C06.jet718__287676 | 035JN007.C06 |
| 1539 | 28997 | 7264.G11.Beta5__496458 | 035JN005.D06 |
| 1540 | 29000 | 7264.J11.Beta5__496461 | 035JN007.E06 |
| 1541 | 29002 | 7264.L11.Beta5__496463 | 035JN007.F06 |
| 1542 | 29016 | 7264.J23.Beta5__496653 | 035JN007.E12 |
| 1543 | 29022 | 035JN007.H12.jet718__287729 | 035JN007.H12 |
| 1544 | 29023 | 035JN009.A06.jet718__288058 | 035JN009.A06 |
| 1545 | 29025 | 7569.C11.Beta5__497715 | 035JN009.B06 |
| 1546 | 29027 | 7569.E11.Beta5__497717 | 035JN009.C06 |
| 1547 | 29038 | 035JN011.H06.jet718__288449 | 035JN011.H06 |
| 1548 | 29044 | 7569.F23.Beta5__497910 | 035JN011.C12 |
| 1549 | 29057 | 035JN013.B06.SP6__315916 | 035JN013.B06 |
| 1550 | 29064 | 7815.J11.Beta5__497338 | 035JN015.E06 |
| 1551 | 29065 | 035JN013.F06.SP6__315920 | 035JN013.F06 |
| 1552 | 29067 | 035JN013.G06.SP6__315921 | 035JN013.G06 |
| 1553 | 29081 | 035JN013.F12.SP6__315968 | 035JN013.F12 |
| 1554 | 29105 | 035JN017.B12.SP6__316636 | 035JN017.B12 |
| 1555 | 29119 | 035JN021.A06.SP6__316971 | 035JN021.A06 |
| 1556 | 29122 | 035JN023.B06.SP6__317164 | 035JN023.B06 |
| 1557 | 29124 | 7852.F11.Beta5__511051 | 035JN023.C06 |
| 1558 | 29129 | 035JN021.F06.SP6__316976 | 035JN021.F06 |
| 1559 | 29142 | 7852.H23.Beta5__511245 | 035JN023.D12 |
| 1560 | 29145 | 7852.K23.Beta5__511248 | 035JN021.F12 |
| 1561 | 29147 | 035JN021.G12.SP6__317025 | 035JN021.G12 |
| 1562 | 29158 | 035JN027.D06.GZ43__334673 | 035Jn027.D06 |
| 1563 | 29191 | 035JN029.E06.GZ43__334962 | 035Jn029.E06 |
| 1564 | 29194 | 7947.L11.Beta5__483808 | 035Jn031.F06 |
| 1565 | 29204 | 7947.F23.Beta5__483994 | 035Jn031.C12 |
| 1566 | 29219 | 037XN001.C06.sp6__317681 | 037XN001.C06 |
| 1567 | 29221 | 037XN001.D06.sp6__317682 | 037XN001.D06 |
| 1568 | 29224 | 037XN003.E06.sp6__317971 | 037XN003.E06 |
| 1569 | 29235 | 037XN001.C12.sp6__317729 | 037XN001.C12 |
| 1570 | 29245 | 037XN001.H12.sp6__317734 | 037XN001.H12 |
| 1571 | 29267 | 037XN005.C12.sp6__318209 | 037XN005.C12 |
| 1572 | 29327 | 035JN002.A12.jet718__283917 | 035JN002.A12 |
| 1573 | 29341 | 035JN002.H12.jet718__283924 | 035JN002.H12 |
| 1574 | 29348 | 035JN008.C06.jet718__287868 | 035JN008.C06 |
| 1575 | 29349 | 7264.G12.Beta5__496474 | 035JN006.D06 |
| 1576 | 29350 | 035JN008.D06.jet718__287869 | 035JN008.D06 |
| 1577 | 29352 | 035JN008.E06.jet718__287870 | 035JN008.E06 |
| 1578 | 29356 | 035JN008.G06.jet718__287872 | 035JN008.G06 |
| 1579 | 29361 | 7264.C24.Beta5__496662 | 035JN006.B12 |
| 1580 | 29362 | 035JN008.B12.jet718__287915 | 035JN008.B12 |
| 1581 | 29369 | 7264.K24.Beta5__496670 | 035JN006.F12 |
| 1582 | 29370 | 035JN008.F12.jet718__287919 | 035JN008.F12 |
| 1583 | 29378 | 7569.D12.Beta5__497732 | 035JN012.B06 |
| 1584 | 29383 | 7569.I12.Beta5__497737 | 035JN010.E06 |
| 1585 | 29386 | 035JN012.F06.jet718__288639 | 035JN012.F06 |
| 1586 | 29388 | 035JN012.G06.jet718__288640 | 035JN012.G06 |
| 1587 | 29395 | 7569.E24.Beta5__497925 | 035JN010.C12 |
| 1588 | 29421 | 035JN014.H06.SP6__316018 | 035JN014.H06 |
| 1589 | 29427 | 7815.E24.Beta5__497541 | 035JN014.C12 |
| 1590 | 29442 | 035JN020.B06.SP6__316876 | 035JN020.B06 |
| 1591 | 29444 | 035JN020.C06.SP6__316877 | 035JN020.C06 |
| 1592 | 29454 | 7559.P12.Beta5__511461 | 035JN020.H06 |
| 1593 | 29474 | 035JN024.B06.SP6__317260 | 035JN024.B06 |
| 1594 | 29476 | 7852.F12.Beta5__511067 | 035JN024.C06 |
| 1595 | 29481 | 035JN022.F06.SP6__317072 | 035JN022.F06 |
| 1598 | 29490 | 035JN024.E12.SP6__317308 | 035JN024.B12 |
| 1597 | 29493 | 7852.G24.Beta5__511260 | 035JN022.D12 |
| 1598 | 29496 | 035JN024.E12.SP6__317311 | 035JN024.E12 |
| 1599 | 29498 | 7852.L24.Beta5__511265 | 035JN024.F12 |

TABLE 15-continued

| SEQ ID NO | Spot Id | Sequence Name | Sample Name or Clone Name |
|---|---|---|---|
| 1600 | 29502 | 7852.P24.Beta5__511269 | 035JN024.H12 |
| 1601 | 29516 | 035JN028.G06.GZ43__334868 | 035JN028.G06 |
| 1602 | 29529 | 035JN026.F12.GZ43__334627 | 035JN026.F12 |
| 1603 | 29534 | 035JN028.H12.GZ43__334917 | 035JN028.H12 |
| 1604 | 29535 | 035JN030.A06.GZ43__335073 | 035JN030.A06 |
| 1605 | 29540 | 035JN032.C06.GZ43__335267 | 035JN032.C06 |
| 1606 | 29544 | 035JN032.E06.GZ43__335269 | 035JN032.E06 |
| 1607 | 29547 | 035JN030.G06.GZ43__335079 | 035JN030.G06 |
| 1608 | 29548 | 035JN032.G06.GZ43__335271 | 035JN032.G06 |
| 1609 | 29553 | 035JN030.B12.GZ43__335122 | 035JN030.B12 |
| 1610 | 29557 | 7947.G24.Beta5__484011 | 035JN030.D12 |
| 1611 | 29573 | 037XN002.D06.sp6__317874 | 037XN002.D06 |
| 1612 | 29619 | 037XN006.C12.sp6__318497 | 037XN006.C12 |
| 1613 | 29621 | 037XN006.D12.sp6__318498 | 037XN006.D12 |
| 1614 | 29652 | 016923 | M00001610C:D05 |
| 1615 | 29668 | 538.C01.BETA5__582849 | 1TNT051800C01 |
| 1616 | 29678 | 538.H01.BETA5__582854 | 1TNT051800H01 |
| 1617 | 29684 | 1TNT051800.C07.GZ43__421387 | 1TNT051800C07 |
| 1618 | 29690 | 538.F07.BETA5__582900 | 1TNT051800F07 |
| 1619 | 29691 | 5383.F07.T3__583092 | 3TNT052200F07 |
| 1620 | 29702 | 539.G01.Laf3__581001 | RG:2169096:8119907:D01 |
| 1621 | 29704 | AI656423 | RG:2244263:8119907:E01 |
| 1622 | 29706 | AI632432 | RG:2305132:8119907:F01 |
| 1623 | 29708 | 539.M01.Laf3__581007 | RG:2330779:8119907:G01 |
| 1624 | 29710 | 539.O01.Laf3__581009 | RG:2343699:8119907:H01 |
| 1625 | 29716 | 539.E13.Laf3__581191 | RG:2162304:8119907:C07 |
| 1626 | 29724 | AI693174 | RG:2336749:8119907:G07 |
| 1627 | 29754 | 518.K13.laf3__548279 | RG:233016:12039905:F07 |
| 1628 | 29757 | AI347985 | RG:1926969:12039908:G07 |
| 1629 | 29771 | 519.L01.laf3__548472 | RG:267235:Order7TM21:F01 |
| 1630 | 29796 | N94487 | RG:309893:Order7TM23:C01 |
| 1631 | 29805 | 520.N01.laf3__558990 | RG:2370175:OrderK03:G01 |
| 1632 | 29808 | N95025 | RG:306549:Order7TM23:A07 |
| 1633 | 29814 | 520.G13.laf3__559175 | RG:323370:Order7TM23:D07 |
| 1634 | 29834 | 521.K01.laf3__559371 | RG:46429:Order7TM02:F01 |
| 1635 | 29846 | 521.G13.laf3__559559 | RG:43428:Order7TM02:D07 |
| 1636 | 29859 | 522.D01.laf3__559748 | RG:469703:Order7TM27:B01 |
| 1637 | 29870 | 522.O01.laf3__559759 | RG:450056:Order7TM26:H01 |
| 1638 | 29880 | AA203687 | RG:446190:Order7TM26:E07 |
| 1639 | 29886 | AA700861 | RG:452343:Order7TM26:H07 |
| 1640 | 29888 | 523.A01.laf3__560129 | RG:725230:Order7TM31:A01 |
| 1641 | 29891 | 523.D01.laf3__560132 | RG:1160829:Order7TM33:B01 |
| 1642 | 29907 | 523.D13.laf3__560324 | RG:1161304:Order7TM33:B07 |
| 1643 | 29957 | 525.F01.laf3__560902 | RG:2149250:Order7TM41:C01 |
| 1644 | 29966 | AA937194 | RG:1507689:Order7TM37:H01 |
| 1645 | 29987 | AI270150 | RG:1985920:20003:B01 |
| 1646 | 29997 | AI250101 | RG:2006710:20003:G01 |
| 1647 | 30013 | AI251081 | RG:2007272:20003:G07 |
| 1648 | 30016 | 5382.A01.BETA5__582943 | 2TNT052200A01 |
| 1649 | 30022 | 5382.D01.BETA5__582946 | 2TNT052200D01 |
| 1650 | 30024 | 5382.E01.BETA5__582947 | 2TNT052200E01 |
| 1651 | 30027 | PL4B052400.A04.GZ43__421705 | PL4B052400A04 |
| 1652 | 30043 | PL4B052400.G04.GZ43__421711 | PL4B052400G04 |
| 1653 | 30047 | PL4B052400.G07.GZ43__421735 | PL4B052400G07 |
| 1654 | 30073 | 539.J14.Laf3__581212 | RG:326321:OrderK01:E07 |
| 1655 | 30080 | 518.A02.laf3__548093 | RG:342025:12039906:A01 |
| 1656 | 30092 | 518.M02.laf3__548105 | RG:704530:12039906:G01 |
| 1657 | 30094 | AA625677 | RG:744852:12039906:H01 |
| 1658 | 30095 | 518.P02.laf3__548108 | RG:1486908:Order7TM11:H01 |
| 1659 | 30097 | AA643303 | RG:1172246:Order7TM11:A07 |
| 1660 | 30099 | AA657977 | RG:1174569:Order7TM11:B07 |
| 1661 | 30114 | 519.C02.laf3__548479 | RG:200526:Order7TM20:B01 |
| 1662 | 30120 | 519.I02.laf3__548485 | RG:219754:Order7TM20:E01 |
| 1663 | 30137 | W05177 | RG:295191:Order7TM22:E07 |
| 1664 | 30156 | AA016156 | RG:360639:Order7TM24:G01 |
| 1665 | 30205 | 521.N14.laf3__559582 | RG:152346:Order7TM17:G07 |
| 1666 | 30231 | 522.H14.laf3__559960 | RG:712130:Order7TM30:D07 |
| 1667 | 30232 | AA059350 | RG:381856:Order7TM25:E07 |
| 1668 | 30241 | AA741244 | RG:1286112:Order7TM34:A01 |
| 1669 | 30248 | AA465303 | RG:814153:Order7TM32:E01 |
| 1670 | 30274 | 524.C02.laf3__560531 | RG:1387330:Order7TM36:B01 |
| 1671 | 30282 | 524.K02.laf3__560539 | RG:1408000:Order7TM36:F01 |
| 1672 | 30303 | 524.P14.laf3__560736 | RG:1569511:Order7TM38:H07 |
| 1673 | 30329 | 525.J14.laf3__561114 | RG:2393918:Order7TM42:E07 |
| 1674 | 30372 | 538.C02.BETA5__582857 | 1TNT051800C02 |
| 1675 | 30374 | 1TNT051800.D02.GZ43__421348 | 1TNT051800D02 |

TABLE 15-continued

| SEQ ID NO | Spot Id | Sequence Name | Sample Name or Clone Name |
|---|---|---|---|
| 1676 | 30377 | 3TNT052200.E02.T3__421561 | 3TNT052200E02 |
| 1677 | 30380 | 1TNT051800.G02.GZ43__421351 | 1TNT051800G02 |
| 1678 | 30394 | 1TNT051800.F08.GZ43__421398 | 1TNT051800F08 |
| 1679 | 30397 | 3TNT052200.G08.T3__421611 | 3TNT052200G08 |
| 1680 | 30420 | 539.E15.Laf3__581223 | RG:2166404:8119907:C08 |
| 1681 | 30457 | AI143947 | RG:1737690:12039908:E08 |
| 1682 | 30462 | 518.O15.laf3__548315 | RG:322130:12039905:H08 |
| 1683 | 30463 | 518.P15.laf3__548316 | RG:2114092:12039908:H08 |
| 1684 | 30472 | 519.I03.laf3__548501 | RG:182411:Order7TM19:E02 |
| 1685 | 30486 | 519.G15.laf3__548691 | RG:180757:Order7TM19:D08 |
| 1686 | 30489 | N26748 | RG:266375:Order7TM21:E08 |
| 1687 | 30492 | 519.M15.laf3__548697 | RG:188269:Order7TM19:G08 |
| 1688 | 30510 | 520.O03.laf3__559023 | RG:342337:Order7TM23:H02 |
| 1689 | 30538 | 521.K03.laf3__559403 | RG:46640:Order7TM02:F02 |
| 1690 | 30541 | 521.N03.laf3__559406 | RG:128956:Order7TM16:G02 |
| 1691 | 30546 | 521.C15.laf3__559587 | RG:41160:Order7TM02:B08 |
| 1692 | 30569 | AA125857 | RG:490269:Order7TM27:E02 |
| 1693 | 30579 | AA031460 | RG:470675:Order7TM27:B08 |
| 1694 | 30597 | 523.F03.laf3__560166 | RG:1185595:Order7TM33:C02 |
| 1695 | 30603 | AA746602 | RG:1256454:Order7TM33:F02 |
| 1696 | 30606 | 523.O03.laf3__560175 | RG:739884:Order7TM31:H02 |
| 1697 | 30617 | AA731737 | RG:1251980:Order7TM33:E08 |
| 1698 | 30641 | 524.B15.laf3__560738 | RG:1584415:Order7TM39:A08 |
| 1699 | 30660 | 525.E03.laf3__560933 | RG:1468027:Order7TM37:C02 |
| 1700 | 30662 | 525.G03.laf3__560935 | RG:1470342:Order7TM37:D02 |
| 1701 | 30685 | AI688238 | RG:2326234:Order7TM41:G08 |
| 1702 | 30690 | R28103 | RG:133909:OrderP01:B02 |
| 1703 | 30708 | H85938 | RG:222589:OrderP01:C08 |
| 1704 | 30715 | AI279390 | RG:2006302:20003:F08 |
| 1705 | 30720 | 2TNT052200.A02.GZ43__421441 | 2TNT052200A02 |
| 1706 | 30722 | 2TNT052200.B02.GZ43__421442 | 2TNT052200B02 |
| 1707 | 30723 | 5384.B02.T3__583144 | 4ATNT052400F02 |
| 1708 | 30725 | 5384.C02.T3__583145 | 4ATNT052400B04 |
| 1709 | 30728 | 5382.E02.BETA5__582955 | 2TNT052200E02 |
| 1710 | 30731 | PL4B052400.B04.GZ43__421706 | PL4B052400B04 |
| 1711 | 30787 | 518.D04.laf3__548128 | RG:1173695:Order7TM11:B02 |
| 1712 | 30789 | AA650509 | RG:1191849:Order7TM11:C02 |
| 1713 | 30795 | 518.L04.laf3__548136 | RG:1420834:Order7TM11:F02 |
| 1714 | 30796 | 518.M04.laf3__548137 | RG:713079:12039906:G02 |
| 1715 | 30798 | AA625800 | RG:744928:12039906:H02 |
| 1716 | 30803 | AA827000 | RG:1174978:Order7TM11:B08 |
| 1717 | 30818 | 519.C04.laf3__548511 | RG:200526:Order7TM20:B02 |
| 1718 | 30819 | 519.D04.laf3__548512 | RG:279704:Order7TM22:B02 |
| 1719 | 30825 | 519.J04.laf3__548518 | RG:293781:Order7TM22:E02 |
| 1720 | 30831 | 519.P04.laf3__548524 | RG:301734:Order7TM22:H02 |
| 1721 | 30836 | H48592 | RG:207207:Order7TM20:C08 |
| 1722 | 30840 | 519.I16.laf3__548709 | RG:221499:Order7TM20:E08 |
| 1723 | 30841 | 519.J16.laf3__548710 | RG:295687:Order7TM22:E08 |
| 1724 | 30852 | W72005 | RG:345670:Order7TM24:C02 |
| 1725 | 30853 | 520.F04.laf3__559030 | RG:25631:Order7TM01:C02 |
| 1726 | 30860 | AA015780 | RG:360663:Order7TM24:G02 |
| 1727 | 30881 | 521.B04.laf3__559410 | RG:136866:Order7TM17:A02 |
| 1728 | 30898 | 521.C16.laf3__559603 | RG:155253:Order7TM18:B08 |
| 1729 | 30905 | 521.J16.laf3__559610 | RG:147116:Order7TM17:E08 |
| 1730 | 30906 | 521.K16.laf3__559611 | RG:163644:Order7TM18:F08 |
| 1731 | 30908 | 521.M16.laf3__559613 | RG:166144:Order7TM18:G08 |
| 1732 | 30910 | H18391 | RG:171738:Order7TM18:H08 |
| 1733 | 30914 | AA032228 | RG:375685:Order7TM25:B02 |
| 1734 | 30925 | 522.N04.laf3__559806 | RG:714002:Order7TM30:G02 |
| 1735 | 30934 | 522.G16.laf3__559991 | RG:380369:Order7TM25:D08 |
| 1736 | 30938 | AA709067 | RG:384795:Order7TM25:F08 |
| 1737 | 30940 | 522.M16.laf3__559997 | RG:397720:Order7TM25:G08 |
| 1738 | 30943 | 522.P16.laf3__560000 | RG:724677:Order7TM30:H08 |
| 1739 | 30963 | 523.D16.laf3__560372 | RG:1290416:Order7TM34:B08 |
| 1740 | 30988 | AA846062 | RG:1414105:Order7TM36:G02 |
| 1741 | 30999 | 524.H16.laf3__560760 | RG:1541688:Order7TM38:D08 |
| 1742 | 31004 | 524.M16.laf3__560765 | RG:1415237:Order7TM36:G08 |
| 1743 | 31006 | 524.O16.laf3__560767 | RG:1455902:Order7TM36:H08 |
| 1744 | 31007 | 524.P16.laf3__560768 | RG:1570363:Order7TM38:H08 |
| 1745 | 31013 | 525.F04.laf3__560950 | RG:2362806:Order7TM42:C02 |
| 1746 | 31016 | 525.I04.laf3__560953 | RG:1939313:Order7TM40:E02 |
| 1747 | 31044 | 526.E04.laf3__561333 | RG:1369150:OrderP02:C02 |
| 1748 | 31048 | 526.I04.laf3__561337 | RG:1750632:OrderP02:E02 |
| 1749 | 31076 | 538.C03.BETA5__582865 | 1TNT051800C03 |
| 1750 | 31080 | 1TNT051800.E03.GZ43__421357 | 1TNT051800E03 |
| 1751 | 31085 | 5383.G03.T3__583061 | 3TNT052200G03 |

TABLE 15-continued

| SEQ ID NO | Spot Id | Sequence Name | Sample Name or Clone Name |
|---|---|---|---|
| 1752 | 31091 | 5383.B09.T3__583104 | 3TNT052200B09 |
| 1753 | 31092 | 1TNT051800.C09.GZ43__421403 | 1TNT051800C09 |
| 1754 | 31094 | 538.D09.BETA5__582914 | 1TNT051800D09 |
| 1755 | 31098 | 538.F09.BETA5__582916 | 1TNT051800F09 |
| 1756 | 31100 | 538.G09.BETA5__582917 | 1TNT051800G09 |
| 1757 | 31105 | 539.B05.Laf3__581060 | RG:796055:12039907:A03 |
| 1758 | 31107 | 539.D05.Laf3__581062 | RG:986456:12039907:B03 |
| 1759 | 31123 | AA639504 | RG:1159614:12039907:B09 |
| 1760 | 31127 | AA844912 | RG:1411982:12039907:D09 |
| 1761 | 31130 | AI676053 | RG:2314226:8119907:F09 |
| 1762 | 31149 | 518.N05.laf3__548154 | RG:1902348:12039908:G03 |
| 1763 | 31159 | AA996029 | RG:1606839:12039908:D09 |
| 1764 | 31187 | 519.D17.laf3__548720 | RG:252455:Order7TM21:B09 |
| 1765 | 31192 | H44426 | RG:183706:Order7TM19:E09 |
| 1766 | 31195 | 519.L17.laf3__548728 | RG:269238:Order7TM21:F09 |
| 1767 | 31232 | 521.A05.laf3__559425 | RG:38689:Order7TM02:A03 |
| 1768 | 31282 | 522.C17.laf3__560003 | RG:417746:Order7TM26:B09 |
| 1769 | 31286 | 522.G17.laf3__560007 | RG:435378:Order7TM26:D09 |
| 1770 | 31296 | 523.A05.laf3__560193 | RG:725269:Order7TM31:A03 |
| 1771 | 31299 | 523.D05.laf3__560196 | RG:1160942:Order7TM33:B03 |
| 1772 | 31300 | 523.E05.laf3__560197 | RG:726119:Order7TM31:C03 |
| 1773 | 31303 | AA652642 | RG:1188375:Order7TM33:D03 |
| 1774 | 31309 | 523.N05.laf3__560206 | RG:1270265:Order7TM33:G03 |
| 1775 | 31312 | 523.A17.laf3__560385 | RG:725415:Order7TM31:A09 |
| 1776 | 31314 | AA292293 | RG:725865:Order7TM31:B09 |
| 1777 | 31335 | AI051307 | RG:1657255:Order7TM39:D03 |
| 1778 | 31337 | AI076453 | RG:1675585:Order7TM39:E03 |
| 1779 | 31351 | 524.H17.laf3__560776 | RG:1667691:Order7TM39:D09 |
| 1780 | 31361 | 525.B05.laf3__560962 | RG:2115059:Order7TM41:A03 |
| 1781 | 31367 | AI623315 | RG:2237582:Order7TM41:D03 |
| 1782 | 31369 | AI659657 | RG:2252059:Order7TM41:E03 |
| 1783 | 31389 | 525.N17.laf3__561166 | RG:2327992:Order7TM41:G09 |
| 1784 | 31393 | AI733957 | RG:1985759:20003:A03 |
| 1785 | 31399 | AI305310 | RG:1997027:20003:D03 |
| 1786 | 31408 | 526.A17.laf3__561537 | RG:126566:OrderP01:A09 |
| 1787 | 31410 | R87386 | RG:1166034:OrderP01:B09 |
| 1788 | 31419 | AI265909 | RG:2006498:20003:F09 |
| 1789 | 31426 | 5382.B03.BETA5__582960 | 2TNT052200B03 |
| 1790 | 31435 | PL4B052400.C04.GZ43__421707 | PL4B052400C04 |
| 1791 | 31444 | 5382.C09.BETA5__583009 | 2TNT052200C09 |
| 1792 | 31447 | PL4B052400.A02.GZ43__421689 | PL4B052400A02 |
| 1793 | 31449 | PL4B052400.E03.GZ43__421701 | PL4B052400E03 |
| 1794 | 31451 | PL4B052400.A05.GZ43__421713 | PL4B052400A05 |
| 1795 | 31499 | AA858353 | RG:1420889:Order7TM11:F03 |
| 1796 | 31512 | 518.I18.laf3__548357 | RG:1675510:12039906:E09 |
| 1797 | 31515 | 518.L18.laf3__548360 | RG:1422884:Order7TM11:F09 |
| 1798 | 31526 | H68010 | RG:211252:Order7TM20:D03 |
| 1799 | 31535 | 519.P06.laf3__548556 | RG:301871:Order7TM22:H03 |
| 1800 | 31538 | 519.C18.laf3__548735 | RG:202264:Order7TM20:B09 |
| 1801 | 31549 | 519.N18.laf3__548746 | RG:301416:Order7TM22:G09 |
| 1802 | 31554 | 520.C06.laf3__559059 | RG:344661:Order7TM24:B03 |
| 1803 | 31572 | 520.E18.laf3__559253 | RG:346417:Order7TM24:C09 |
| 1804 | 31601 | 521.B18.laf3__559634 | RG:139207:Order7TM17:A09 |
| 1805 | 31629 | 522.N06.laf3__559838 | RG:714036:Order7TM30:G03 |
| 1806 | 31640 | 522.I18.laf3__560025 | RG:381998:Order7TM25:E09 |
| 1807 | 31647 | 522.P18.laf3__560032 | RG:724738:Order7TM30:H09 |
| 1808 | 31663 | 523.P06.laf3__560224 | RG:1323963:Order7TM34:H03 |
| 1809 | 31702 | 524.G18.laf3__560791 | RG:1404328:Order7TM36:D09 |
| 1810 | 31708 | 524.M18.laf3__560797 | RG:1415437:Order7TM36:G09 |
| 1811 | 31729 | 525.B18.laf3__561170 | RG:2350539:Order7TM42:A09 |
| 1812 | 31739 | AI858001 | RG:2408051:Order7TM42:F09 |
| 1813 | 31748 | 526.E06.laf3__561365 | RG:1408115:OrderP02:C03 |
| 1814 | 31763 | AI251231 | RG:1983997:20002:B09 |
| 1815 | 31780 | 538.C04.BETA5__582873 | 1TNT051800C04 |
| 1816 | 31782 | 1TNT051800.D04.GZ43__421364 | 1TNT051800D04 |
| 1817 | 31786 | 538.F04.BETA5__582876 | 1TNT051800F04 |
| 1818 | 31787 | 5383.F04.T3__583068 | 3TNT052200F04 |
| 1819 | 31788 | 1TNT051800.G04.GZ43__421367 | 1TNT051800G04 |
| 1820 | 31796 | 538.C10.BETA5__582921 | 1TNT051800C10 |
| 1821 | 31799 | 5383.D10.T3__583114 | 3TNT052200D10 |
| 1822 | 31804 | 1TNT051800.G10.GZ43__421415 | 1TNT051800G10 |
| 1823 | 31805 | 3TNT052200.G10.T3__421627 | 3TNT052200G10 |
| 1824 | 31813 | 539.F07.Laf3__581096 | RG:1269319:12039907:C04 |
| 1825 | 31850 | 518.K07.laf3__548183 | RG:230376:12039905:F04 |
| 1826 | 31856 | T85544 | RG:114712:12039905:A10 |
| 1827 | 31862 | 518.G19.laf3__548371 | RG:195021:12039905:D10 |

TABLE 15-continued

| SEQ ID NO | Spot Id | Sequence Name | Sample Name or Clone Name |
|---|---|---|---|
| 1828 | 31865 | AI148954 | RG:1752672:12039908:E10 |
| 1829 | 31869 | 518.N19.laf3__548378 | RG:2028487:12039908:G10 |
| 1830 | 31871 | 518.P19.laf3__548380 | RG:2124370:12039908:H10 |
| 1831 | 31886 | H39120 | RG:192444:Order7TM19:H04 |
| 1832 | 31887 | 519.P07.laf3__548572 | RG:273979:Order7TM21:H04 |
| 1833 | 31928 | 520.I19.laf3__559273 | RG:324794:Order7TM23:E10 |
| 1834 | 31952 | 521.A19.laf3__559649 | RG:39899:Order7TM02:A10 |
| 1835 | 31965 | R25637 | RG:132735:Order7TM16:G10 |
| 1836 | 31997 | 522.N19.laf3__560046 | RG:504638:Order7TM27:G10 |
| 1837 | 32006 | 523.G07.laf3__560231 | RG:726383:Order7TM31:D04 |
| 1838 | 32007 | 523.H07.laf3__560232 | RG:1188503:Order7TM33:D04 |
| 1839 | 32023 | 523.H19.laf3__560424 | RG:1218621:Order7TM33:D10 |
| 1840 | 32043 | AI092466 | RG:1692984:Order7TM39:F04 |
| 1841 | 32062 | AA836494 | RG:1370254:Order7TM35:H10 |
| 1842 | 32065 | 525.B07.laf3__560994 | RG:2115148:Order7TM41:A04 |
| 1843 | 32068 | AA884832 | RG:1468143:Order7TM37:C04 |
| 1844 | 32082 | 525.C19.laf3__561187 | RG:1466558:Order7TM37:B10 |
| 1845 | 32097 | AI734002 | RG:1985794:20003:A04 |
| 1846 | 32103 | AI305307 | RG:1997021:20003:D04 |
| 1847 | 32104 | 526.I07.laf3__561385 | RG:299652:OrderP01:E04 |
| 1848 | 32125 | AI249647 | RG:2007319:20003:G10 |
| 1849 | 32128 | 5382.A04.BETA5__582967 | 2TNT052200A04 |
| 1850 | 32139 | PL4B052400.D04.GZ43__421708 | PL4B052400D04 |
| 1851 | 32142 | 2TNT052200.H04.GZ43__421464 | 2TNT052200H04 |
| 1852 | 32155 | PL4B052400.B05.GZ43__421714 | PL4B052400B05 |
| 1853 | 32158 | 5382.H10.BETA5__583022 | 2TNT052200H10 |
| 1854 | 32198 | AA428964 | RG:769707:12039906:D04 |
| 1855 | 32208 | 518.A20.laf3__548381 | RG:347271:12039906:A10 |
| 1856 | 32209 | AA641485 | RG:1172529:Order7TM11:A10 |
| 1857 | 32212 | AA411086 | RG:724468:12039906:C10 |
| 1858 | 32217 | AA826627 | RG:1420265:Order7TM11:E10 |
| 1859 | 32219 | AA828222 | RG:1422995:Order7TM11:F10 |
| 1860 | 32221 | AA862155 | RG:1485919:Order7TM11:G10 |
| 1861 | 32231 | 519.H08.laf3__548580 | RG:291488:Order7TM22:D04 |
| 1862 | 32241 | 519.B20.laf3__548766 | RG:279067:Order7TM22:A10 |
| 1863 | 32248 | H86259 | RG:223442:Order7TM20:E10 |
| 1864 | 32275 | 520.D20.laf3__559284 | RG:24729:Order7TM01:B10 |
| 1865 | 32282 | AA013201 | RG:360131:Order7TM24:F10 |
| 1866 | 32284 | AA018407 | RG:362533:Order7TM24:G10 |
| 1867 | 32285 | R49164 | RG:36797:Order7TM01:G10 |
| 1868 | 32288 | 521.A08.laf3__559473 | RG:153781:Order7TM18:A04 |
| 1869 | 32292 | 521.E08.laf3__559477 | RG:155964:Order7TM18:C04 |
| 1870 | 32295 | 521.H08.laf3__559480 | RG:144155:Order7TM17:D04 |
| 1871 | 32304 | R53113 | RG:154422:Order7TM18:A10 |
| 1872 | 32309 | 521.F20.laf3__559670 | RG:143670:Order7TM17:C10 |
| 1873 | 32317 | R49761 | RG:152624:Order7TM17:G10 |
| 1874 | 32320 | 522.A08.laf3__559857 | RG:365486:Order7TM25:A04 |
| 1875 | 32347 | AA292684 | RG:713779:Order7TM30:F10 |
| 1876 | 32358 | AA460529 | RG:796624:Order7TM32:D04 |
| 1877 | 32371 | AA761894 | RG:1290472:Order7TM34:B10 |
| 1878 | 32386 | 524.C08.laf3__560627 | RG:1387448:Order7TM36:B04 |
| 1879 | 32388 | AA844385 | RG:1390752:Order7TM36:C04 |
| 1880 | 32395 | AA913293 | RG:1554722:Order7TM38:F04 |
| 1881 | 32465 | AI254029 | RG:1983593:20002:A10 |
| 1882 | 32469 | AI251722 | RG:1984571:20002:C10 |
| 1883 | 32480 | 1TNT051800.A05.GZ43__421369 | 1TNT051800A05 |
| 1884 | 32484 | 1TNT051800.C05.GZ43__421371 | 1TNT051800C05 |
| 1885 | 32488 | 538.E05.BETA5__582883 | 1TNT051800E05 |
| 1886 | 32499 | 5383.B11.T3__583120 | 3TNT052200B11 |
| 1887 | 32506 | 538.F11.BETA5__582932 | 1TNT051800F11 |
| 1888 | 32512 | 539.A09.Laf3__581123 | RG:2124082:8119907:A05 |
| 1889 | 32516 | 539.E09.laf3__581127 | RG:2160113:8119907:C05 |
| 1890 | 32544 | T81096 | RG:109165:12039905:A05 |
| 1891 | 32556 | N30787 | RG:257079:12039905:G05 |
| 1892 | 32558 | 518.O09.laf3__548219 | RG:300634:12039905:H05 |
| 1893 | 32564 | R55625 | RG:154770:12039905:C11 |
| 1894 | 32574 | 518.O21.laf3__548411 | RG:325930:12039905:H11 |
| 1895 | 32580 | 519.E09.laf3__548593 | RG:179266:Order7TM19:C05 |
| 1896 | 32583 | 519.H09.laf3__548596 | RG:263993:Order7TM21:D05 |
| 1897 | 32591 | 519.P09.laf3__548604 | RG:273969:Order7TM21:H05 |
| 1898 | 32594 | 519.C21.laf3__548783 | RG:178479:Order7TM19:B11 |
| 1899 | 32596 | H51124 | RG:179642:Order7TM19:C11 |
| 1900 | 32628 | 520.E21.laf3__559301 | RG:321260:Order7TM23:C11 |
| 1901 | 32645 | T77432 | RG:113840:Order7TM16:C05 |
| 1902 | 32652 | 521.M09.laf3__559501 | RG:48922:Order7TM02:G05 |
| 1903 | 32654 | 521.O09.laf3__559503 | RG:50127:Order7TM02:H05 |

TABLE 15-continued

| SEQ ID NO | Spot Id | Sequence Name | Sample Name or Clone Name |
|---|---|---|---|
| 1904 | 32662 | 521.G21.laf3__559687 | RG:44286:Order7TM02:D11 |
| 1905 | 32666 | 521.K21.laf3__559691 | RG:48256:Order7TM02:F11 |
| 1906 | 32670 | 521.O21.laf3__559695 | RG:51009:Order7TM02:H11 |
| 1907 | 32684 | AA702455 | RG:447950:Order7TM26:G05 |
| 1908 | 32688 | 522.A21.laf3__560065 | RG:415681:Order7TM26:A11 |
| 1909 | 32702 | AA779154 | RG:452641:Order7TM26:H11 |
| 1910 | 32725 | AA650031 | RG:1187678:Order7TM33:C11 |
| 1911 | 32733 | AA743401 | RG:1272563:Order7TM33:G11 |
| 1912 | 32751 | 524.P09.laf3__560656 | RG:1752807:Order7TM39:H05 |
| 1913 | 32775 | AI638529 | RG:2240207:Order7TM41:D05 |
| 1914 | 32799 | 525.P21.laf3__561232 | RG:2342176:Order7TM41:H11 |
| 1915 | 32811 | AI223784 | RG:2003087:20003:F05 |
| 1916 | 32828 | AA250856 | RG:684365:OrderP01:G11 |
| 1917 | 32829 | AI246847 | RG:2007337:20003:G11 |
| 1918 | 32830 | 526.O21.laf3__561615 | RG:753277:OrderP01:H11 |
| 1919 | 32835 | 4ATNT052400.A03.T3__421661 | 4ATNT052400A03 |
| 1920 | 32839 | PL4B052400.E01.GZ43__421685 | PL4B052400E01 |
| 1921 | 32842 | 5382.F05.BETA5__582980 | 2TNT052200F05 |
| 1922 | 32843 | PL4B052400.E04.GZ43__421709 | PL4B052400E04 |
| 1923 | 32848 | 5382.A11.BETA5__583023 | 2TNT052200A11 |
| 1924 | 32854 | 5382.D11.BETA5__583026 | 2TNT052200D11 |
| 1925 | 32872 | AI150354 | RG:1752018:OrderK02:E05 |
| 1926 | 32883 | 539.D22.Laf3__581334 | RG:180447:OrderK01:B11 |
| 1927 | 32891 | 539.L22.Laf3__581342 | RG:470447:OrderK01:F11 |
| 1928 | 32904 | AI033477 | RG:1655516:12039906:E05 |
| 1929 | 32907 | AA834081 | RG:1422219:Order7TM11:F05 |
| 1930 | 32930 | 519.C10.laf3__548607 | RG:201469:Order7TM20:B05 |
| 1931 | 32932 | 519.E10.laf3__548609 | RG:205963:Order7TM20:C05 |
| 1932 | 32934 | 519.G10.laf3__548611 | RG:211565:Order7TM20:D05 |
| 1933 | 32938 | 519.K10.laf3__548615 | RG:232881:Order7TM20:F05 |
| 1934 | 32940 | 519.M10.laf3__548617 | RG:236186:Order7TM20:G05 |
| 1935 | 32952 | 519.I22.laf3__548805 | RG:229279:Order7TM20:E11 |
| 1936 | 32963 | 520.D10.laf3__559124 | RG:23984:Order7TM01:B05 |
| 1937 | 32998 | 521.G10.laf3__559511 | RG:158151:Order7TM18:D05 |
| 1938 | 33016 | 521.I22.laf3__559705 | RG:163004:Order7TM18:E11 |
| 1939 | 33018 | 521.K22.laf3__559707 | RG:165830:Order7TM18:F11 |
| 1940 | 33023 | 521.P22.laf3__559712 | RG:153398:Order7TM17:H11 |
| 1941 | 33037 | 522.N10.laf3__559902 | RG:714057:Order7TM30:G05 |
| 1942 | 33044 | 522.E22.laf3__560085 | RG:378869:Order7TM25:C11 |
| 1943 | 33047 | 522.H22.laf3__560088 | RG:712463:Order7TM30:D11 |
| 1944 | 33109 | AA919075 | RG:1535701:Order7TM38:C11 |
| 1945 | 33122 | AI263529 | RG:1857034:Order7TM40:B05 |
| 1946 | 33125 | 525.F10.laf3__561046 | RG:2365503:Order7TM42:C05 |
| 1947 | 33135 | 525.P10.laf3__561056 | RG:2504825:Order7TM42:H05 |
| 1948 | 33136 | AI248597 | RG:1850163:Order7TM40:A11 |
| 1949 | 33147 | AI820024 | RG:2408918:Order7TM42:F11 |
| 1950 | 33148 | AI553937 | RG:2090491:Order7TM40:G11 |
| 1951 | 33155 | AI251395 | RG:1983835:20002:B05 |
| 1952 | 33180 | 526.M22.laf3__561629 | RG:2271099:OrderP02:G11 |
| 1953 | 33191 | 5383.D06.T3__583082 | 3TNT052200D06 |
| 1954 | 33202 | 538.B12.BETA5__582936 | 1TNT051800B12 |
| 1955 | 33204 | 538.C12.BETA5__582937 | 1TNT051800C12 |
| 1956 | 33209 | 5383.E12.T3__583131 | 3TNT052200E12 |
| 1957 | 33216 | 539.A11.Laf3__581155 | RG:2124966:8119907:A06 |
| 1958 | 33218 | AI457674 | RG:2144771:8119907:B06 |
| 1959 | 33220 | AI478225 | RG:2161567:8119907:C06 |
| 1960 | 33221 | 539.F11.Laf3__581160 | RG:1322461:12039907:C06 |
| 1961 | 33222 | 539.G11.Laf3__581161 | RG:2213638:8119907:D06 |
| 1962 | 33232 | 539.A23.Laf3__581347 | RG:2131578:8119907:A12 |
| 1963 | 33235 | AA662728 | RG:1218062:12039907:B12 |
| 1964 | 33244 | 539.M23.Laf3__581359 | RG:2341674:8119907:G12 |
| 1965 | 33248 | 518.A11.laf3__548237 | RG:110380:12039905:A06 |
| 1966 | 33249 | 518.B11.laf3__548238 | RG:1412814:12039908:A06 |
| 1967 | 33253 | 518.F11.laf3__548242 | RG:1526787:12039908:C06 |
| 1968 | 33254 | 518.G11.laf3__548243 | RG:183599:12039905:D06 |
| 1969 | 33261 | AI346645 | RG:1926602:12039908:G06 |
| 1970 | 33275 | 518.L23.laf3__548440 | RG:1872818:12039908:F12 |
| 1971 | 33287 | N28612 | RG:264033:Order7TM21:D06 |
| 1972 | 33291 | 519.L11.laf3__548632 | RG:269093:Order7TM21:F06 |
| 1973 | 33293 | 519.N11.laf3__548634 | RG:271623:Order7TM21:G06 |
| 1974 | 33294 | H38515 | RG:192671:Order7TM19:H06 |
| 1975 | 33301 | 519.F23.laf3__548818 | RG:262317:Order7TM21:C12 |
| 1976 | 33328 | 520.A23.laf3__559329 | RG:308004:Order7TM23:A12 |
| 1977 | 33330 | 520.C23.laf3__559331 | RG:309559:Order7TM23:B12 |
| 1978 | 33350 | R61591 | RG:37697:Order7TM02:D06 |
| 1979 | 33351 | T91350 | RG:116459:Order7TM16:D06 |

TABLE 15-continued

| SEQ ID NO | Spot Id | Sequence Name | Sample Name or Clone Name |
|---|---|---|---|
| 1980 | 33355 | 521.L11.laf3__559532 | RG:126266:Order7TM16:F06 |
| 1981 | 33359 | 521.P11.laf3__559536 | RG:134800:Order7TM16:H06 |
| 1982 | 33360 | 521.A23.laf3__559713 | RG:39932:Order7TM02:A12 |
| 1983 | 33374 | 521.O23.laf3__559727 | RG:51276:Order7TM02:H12 |
| 1984 | 33396 | AA678187 | RG:430831:Order7TM26:C12 |
| 1985 | 33417 | AA731087 | RG:1251730:Order7TM33:E06 |
| 1986 | 33434 | 523.K23.laf3__560491 | RG:728661:Order7TM31:F12 |
| 1987 | 33458 | AA810410 | RG:1338465:Order7TM35:B12 |
| 1988 | 33486 | AA902928 | RG:1516750:Order7TM37:H06 |
| 1989 | 33496 | AA909778 | RG:1476569:Order7TM37:E12 |
| 1990 | 33506 | 526.C11.laf3__561443 | RG:151456:OrderP01:B06 |
| 1991 | 33513 | AI223471 | RG:2002542:20003:E06 |
| 1992 | 33531 | AI265824 | RG:2006592:20003:F12 |
| 1993 | 33533 | AI246860 | RG:2007366:20003:G12 |
| 1994 | 33539 | 5384.B06.T3__583176 | 4ATNT052400B03 |
| 1995 | 33551 | PL4B052400.F07.GZ43__421734 | PL4B052400F07 |
| 1996 | 33554 | 5382.B12.BETA5__583032 | 2TNT052200B12 |
| 1997 | 33555 | 5384.B12.T3__583224 | 4ATNT052400H03 |
| 1998 | 33561 | PL4B052400.H03.GZ43__421704 | PL4B052400H03 |
| 1999 | 33563 | PL4B052400.D05.GZ43__421716 | PL4B052400D05 |
| 2000 | 33565 | PL4B052400.H06.GZ43__421728 | PL4B052400H06 |
| 2001 | 33593 | 539.J24.Laf3__581372 | RG:362359:OrderK01:E12 |
| 2002 | 33603 | 518.D12.laf3__548256 | RG:1173873:Order7TM11:B06 |
| 2003 | 33607 | AA837505 | RG:1410138:Order7TM11:D06 |
| 2004 | 33615 | 518.P12.laf3__548268 | RG:1592447:Order7TM11:H06 |
| 2005 | 33618 | AA702766 | RG:447683:12039906:B12 |
| 2006 | 33621 | 518.F24.laf3__548450 | RG:1239284:Order7TM11:C12 |
| 2007 | 33623 | AA838525 | RG:1418951:Order7TM11:D12 |
| 2008 | 33629 | 518.N24.laf3__548458 | RG:1486533:Order7TM11:G12 |
| 2009 | 33634 | 519.C12.laf3__548639 | RG:201628:Order7TM20:B06 |
| 2010 | 33636 | R98050 | RG:206795:Order7TM20:C06 |
| 2011 | 33664 | 520.A12.laf3__559153 | RG:343572:Order7TM24:A06 |
| 2012 | 33672 | W95805 | RG:358318:Order7TM24:E06 |
| 2013 | 33680 | 520.A24.laf3__559345 | RG:344338:Order7TM24:A12 |
| 2014 | 33682 | 520.C24.laf3__559347 | RG:345553:Order7TM24:B12 |
| 2015 | 33690 | AA016156 | RG:360639:Order7TM24:F12 |
| 2016 | 33693 | R34661 | RG:36928:Order7TM01:G12 |
| 2017 | 33703 | 521.H12.laf3__559544 | RG:144675:Order7TM17:D06 |
| 2018 | 33704 | H22158 | RG:160545:Order7TM18:E06 |
| 2019 | 33716 | R73930 | RG:156777:Order7TM18:C12 |
| 2020 | 33727 | R48093 | RG:153417:Order7TM17:H12 |
| 2021 | 33729 | AA278452 | RG:703940:Order7TM30:A06 |
| 2022 | 33740 | AA701039 | RG:397599:Order7TM25:G06 |
| 2023 | 33742 | 522.O12.laf3__559935 | RG:399390:Order7TM25:H06 |
| 2024 | 33748 | AA778077 | RG:379708:Order7TM25:C12 |
| 2025 | 33755 | 522.L24.laf3__560124 | RG:713954:Order7TM30:F12 |
| 2026 | 33800 | AA843787 | RG:1405420:Order7TM36:E06 |
| 2027 | 33802 | 524.K12.laf3__560699 | RG:1409375:Order7TM36:F06 |
| 2028 | 33819 | 524.L24.laf3__560892 | RG:1559941:Order7TM38:F12 |
| 2029 | 33823 | 524.P24.laf3__560896 | RG:1571250:Order7TM38:H12 |
| 2030 | 33842 | AI264420 | RG:1872799:Order7TM40:B12 |
| 2031 | 33851 | 525.L24.laf3__561276 | RG:2408975:Order7TM42:F12 |
| 2032 | 33892 | 529.D01.beta5__565388 | M00074843D:D02 |
| 2033 | 33902 | 529.N01.beta5__565398 | M00074844D:F09 |
| 2034 | 33919 | 529.O13.beta5__565591 | M00073985B:C09 |
| 2035 | 33923 | 527.C01.beta5__564619 | M00073796C:C06 |
| 2036 | 33925 | 2540.F24.GZ43__372151 | M00073796D:B08 |
| 2037 | 33930 | 527.J01.beta5__564626 | M00072996B:A10 |
| 2038 | 33938 | 527.B13.beta5__564810 | M00074343B:B03 |
| 2039 | 33940 | 2472.E21.GZ43__360966 | M00074343B:B09 |
| 2040 | 33950 | 2472.G02.GZ43__360995 | M00074346D:A10 |
| 2041 | 33951 | 527.O13.beta5__564823 | M00073812A:E09 |
| 2042 | 33965 | 536.N02.beta5__568934 | M00073442B:D12 |
| 2043 | 33973 | 536.F14.beta5__569118 | M00073469B:A09 |
| 2044 | 33979 | 2367.I16.GZ43__346202 | M00073469D:C06 |
| 2045 | 33983 | 536.P14.beta5__569128 | M00073469D:H04 |
| 2046 | 34000 | 535.P01.beta5__568536 | M00073824A:C04 |
| 2047 | 34002 | 535.B13.beta5__568714 | M00073839A:D05 |
| 2048 | 34003 | 535.C13.beta5__568715 | M00075619B:A04 |
| 2049 | 34005 | 2499.F08.GZ43__365363 | M00075621A:F06 |
| 2050 | 34012 | 535.L13.beta5__568724 | M00073843A:C10 |
| 2051 | 34033 | 532.A13.beta5__566793 | M00075166A:A12 |
| 2052 | 34034 | 532.B13.beta5__566794 | M00074666D:B04 |
| 2053 | 34041 | 2491.A18.GZ43__363614 | M00075167A:E12 |
| 2054 | 34058 | 2472.N19.GZ43__361180 | M00074374D:A08 |
| 2055 | 34062 | 531.N01.beta5__566230 | M00074377C:G04 |

TABLE 15-continued

| SEQ ID NO | Spot Id | Sequence Name | Sample Name or Clone Name |
|---|---|---|---|
| 2056 | 34066 | 531.B13.beta5__566410 | M00074402C:C03 |
| 2057 | 34072 | 531.H13.beta5__566416 | M00074423A:B06 |
| 2058 | 34075 | 2474.J01.GZ43__361834 | M00074481A:G09 |
| 2059 | 34120 | 534.H01.beta5__567760 | M00073715A:F05 |
| 2060 | 34124 | 534.L01.beta5__567764 | M00073715B:B06 |
| 2061 | 34131 | 534.C13.beta5__567947 | M00073885B:E06 |
| 2062 | 34134 | 534.F13.beta5__567950 | M00073738C:F01 |
| 2063 | 34139 | 534.K13.beta5__567955 | M00073885D:G11 |
| 2064 | 34142 | 534.N13.beta5__567958 | M00073741A:G07 |
| 2065 | 34167 | 530.G13.beta5__565967 | M00073001A:F07 |
| 2066 | 34168 | 530.H13.beta5__565968 | M00074235A:F11 |
| 2067 | 34184 | 2506.D23.GZ43__366652 | M00073853B:C04 |
| 2068 | 34188 | 2506.E17.GZ43__366670 | M00073854B:G11 |
| 2069 | 34195 | 2467.D11.GZ43__360548 | M00074962C:C08 |
| 2070 | 34202 | 533.J13.beta5__567186 | M00073863C:F12 |
| 2071 | 34203 | 2467.D20.GZ43__360557 | M00074966D:E08 |
| 2072 | 34228 | 537.D13.beta5__569868 | M00074277C:C10 |
| 2073 | 34238 | 2459.C06.GZ43__357046 | M00074278B:F02 |
| 2074 | 34252 | 2561.C08.GZ43__376287 | M00074111A:E09 |
| 2075 | 34260 | 529.D14.beta5__565596 | M00074135D:E06 |
| 2076 | 34270 | 529.N14.beta5__565606 | M00074138D:A08 |
| 2077 | 34271 | 529.O14.beta5__565607 | M00074019C:H06 |
| 2078 | 34272 | 529.P14.beta5__565608 | M00074138D:E07 |
| 2079 | 34274 | 2560.C15.GZ43__375142 | M00074079A:E07 |
| 2080 | 34278 | 527.F02.beta5__564638 | M00074079C:H03 |
| 2081 | 34283 | 527.K02.beta5__564643 | M00074198C:A10 |
| 2082 | 34287 | 527.O02.beta5__564647 | M00074198D:D10 |
| 2083 | 34289 | 527.A14.beta5__564825 | M00074208B:G09 |
| 2084 | 34290 | 527.B14.beta5__564826 | M00074091D:F06 |
| 2085 | 34294 | 527.F14.beta5__564830 | M00074093B:G07 |
| 2086 | 34300 | 527.L14.beta5__564836 | M00074094B:F10 |
| 2087 | 34302 | 527.N14.beta5__564838 | M00074095C:E06 |
| 2088 | 34310 | 536.E01.beta5__568909 | M00074159A:C10 |
| 2089 | 34322 | 536.A13.beta5__569097 | M00074175D:D08 |
| 2090 | 34330 | 536.I13.beta5__569105 | M00074177A:G11 |
| 2091 | 34345 | 2475.O20.GZ43__362357 | M00074567C:E04 |
| 2092 | 34359 | 535.G14.beta5__568735 | M00074602A:F03 |
| 2093 | 34365 | 535.M14.beta5__568741 | M00074604C:G09 |
| 2094 | 34366 | 535.N14.beta5__568742 | M00073517C:B05 |
| 2095 | 34370 | 532.B02.beta5__566618 | M00073897B:D12 |
| 2096 | 34375 | 532.G02.beta5__566623 | M00074872B:A12 |
| 2097 | 34376 | 2542.N11.GZ43__373098 | M00073898B:B05 |
| 2098 | 34392 | 2555.D22.GZ43__373253 | M00073916A:B07 |
| 2099 | 34402 | 531.B02.beta5__566234 | M00074296B:B03 |
| 2100 | 34412 | 531.L02.beta5__566244 | M00074298B:E09 |
| 2101 | 34432 | 531.P14.beta5__566440 | M00074320C:A06 |
| 2102 | 34498 | 2562.P24.GZ43__375847 | M00075409D:H01 |
| 2103 | 34514 | 530.B14.beta5__565978 | M00075412A:G03 |
| 2104 | 34518 | 530.F14.beta5__565982 | M00075431D:F08 |
| 2105 | 34542 | 2491.K18.GZ43__363854 | M00075216B:A03 |
| 2106 | 34544 | 2491.K21.GZ43__363857 | M00075217A:B04 |
| 2107 | 34548 | 2496.B16.GZ43__364123 | M00075241A:F08 |
| 2108 | 34560 | 2496.D03.GZ43__364158 | M00075245A:A06 |
| 2109 | 34563 | 537.C02.beta5__569691 | M00074909B:C10 |
| 2110 | 34565 | 537.E02.beta5__569693 | M00074909D:F05 |
| 2111 | 34569 | 537.I02.beta5__569697 | M00074910B:C09 |
| 2112 | 34574 | 537.N02.beta5__569702 | M00074738C:G02 |
| 2113 | 34575 | 2465.P03.GZ43__358427 | M00074911B:F05 |
| 2114 | 34588 | 2483.G10.GZ43__359809 | M00074757A:F04 |
| 2115 | 34607 | 529.O03.beta5__565431 | M00073969A:A02 |
| 2116 | 34610 | 529.B15.beta5__565610 | M00074857C:F04 |
| 2117 | 34615 | 529.G15.beta5__565615 | M00073986C:B02 |
| 2118 | 34616 | 529.H15.beta5__565616 | M00074858C:E07 |
| 2119 | 34659 | 2367.D02.GZ43__346068 | M00073445C:C02 |
| 2120 | 34661 | 2367.D05.GZ43__346071 | M00073445D:H03 |
| 2121 | 34671 | 536.P04.beta5__568968 | M00073447D:F01 |
| 2122 | 34683 | 536.L16.beta5__569156 | M00073471C:F03 |
| 2123 | 34691 | 535.C03.beta5__568555 | M00075560B:E01 |
| 2124 | 34713 | 2499.G09.GZ43__365388 | M00075626A:F03 |
| 2125 | 34714 | 535.J15.beta5__568754 | M00073844D:F01 |
| 2126 | 34719 | 535.O15.beta5__568759 | M00075626D:H03 |
| 2127 | 34729 | 2490.I24.GZ43__363428 | M00075088A:H02 |
| 2128 | 34734 | 2481.E13.GZ43__358996 | M00074641D:A12 |
| 2129 | 34741 | 532.E15.beta5__566829 | M00075172D:H03 |
| 2130 | 34766 | 531.N03.beta5__566262 | M00074409D:A04 |
| 2131 | 34783 | 531.O15.beta5__566455 | M00074493C:D09 |

TABLE 15-continued

| SEQ ID NO | Spot Id | Sequence Name | Sample Name or Clone Name |
|---|---|---|---|
| 2132 | 34784 | 2473.J12.GZ43__361461 | M00074413A:G11 |
| 2133 | 34818 | 2554.D24.GZ43__375943 | M00073716A:D06 |
| 2134 | 34825 | 2506.P15.GZ43__366932 | M00073873A:A10 |
| 2135 | 34838 | 534.F15.beta5__567982 | M00073744B:D02 |
| 2136 | 34839 | 534.G15.beta5__567983 | M00073888A:C05 |
| 2137 | 34845 | 534.M15.beta5__567989 | M00073888B:E05 |
| 2138 | 34848 | 2554.O09.GZ43__376192 | M00073745C:F11 |
| 2139 | 34849 | 530.A03.beta5__565801 | M00072973B:F11 |
| 2140 | 34851 | 530.C03.beta5__565803 | M00072973C:C03 |
| 2141 | 34856 | 530.H03.beta5__565808 | M00074225C:B10 |
| 2142 | 34858 | 530.J03.beta5__565810 | M00074225C:G04 |
| 2143 | 34865 | 2505.C14.GZ43__366235 | M00073002C:G11 |
| 2144 | 34868 | 2458.E05.GZ43__356709 | M00074239C:A09 |
| 2145 | 34870 | 530.F15.beta5__565998 | M00074240D:H06 |
| 2146 | 34877 | 530.M15.beta5__566005 | M00073003D:A10 |
| 2147 | 34890 | 533.J03.beta5__567026 | M00073855D:H02 |
| 2148 | 34898 | 533.B15.beta5__567210 | M00073864B:B04 |
| 2149 | 34899 | 533.C15.beta5__567211 | M00074968B:A10 |
| 2150 | 34901 | 2467.E15.GZ43__360576 | M00074968B:G06 |
| 2151 | 34903 | 533.G15.beta5__567215 | M00074969B:B06 |
| 2152 | 34912 | 533.P15.beta5__567224 | M00073866C:B06 |
| 2153 | 34921 | 2535.I23.GZ43__370302 | M00073586B:D12 |
| 2154 | 34927 | 2535.J12.GZ43__370315 | M00073587C:B03 |
| 2155 | 34938 | 2459.D06.GZ43__357070 | M00074280D:E06 |
| 2156 | 34940 | 537.L15.beta5__569908 | M00074280D:H03 |
| 2157 | 34945 | 529.A04.beta5__565433 | M00074005A:F07 |
| 2158 | 34956 | 529.L04.beta5__565444 | M00074115C:A05 |
| 2159 | 34971 | 529.K16.beta5__565635 | M00074021B:C04 |
| 2160 | 34983 | 2457.B22.GZ43__356258 | M00074200A:B03 |
| 2161 | 34985 | 527.I04.beta5__564673 | M00074200A:E09 |
| 2162 | 34992 | 527.P04.beta5__564680 | M00074084D:B04 |
| 2163 | 35002 | 527.J16.beta5__564866 | M00074096D:G12 |
| 2164 | 35030 | 536.E15.beta5__569133 | M00074177C:H08 |
| 2165 | 35033 | 536.J15.beta5__569138 | M00074552A:B02 |
| 2166 | 35046 | 2367.O10.GZ43__346340 | M00073493B:A02 |
| 2167 | 35060 | 535.D16.beta5__568764 | M00073518A:F06 |
| 2168 | 35063 | 2480.L16.GZ43__358783 | M00074610B:C08 |
| 2169 | 35080 | 532.H04.beta5__566656 | M00073899D:F10 |
| 2170 | 35088 | 2542.P02.GZ43__373137 | M00073905B:A03 |
| 2171 | 35107 | 531.C04.beta5__566267 | M00074694B:H04 |
| 2172 | 35113 | 531.I04.beta5__566273 | M00074696D:E01 |
| 2173 | 35120 | 531.P04.beta5__566280 | M00074303B:D06 |
| 2174 | 35121 | 531.A16.beta5__566457 | M00074719C:A10 |
| 2175 | 35126 | 531.F16.beta5__566462 | M00074831D:E12 |
| 2176 | 35127 | 531.G16.beta5__566463 | M00074720B:A07 |
| 2177 | 35131 | 531.K16.beta5__566467 | M00074721B:H07 |
| 2178 | 35132 | 2464.C10.GZ43__357738 | M00074832C:F06 |
| 2179 | 35215 | 530.O04.beta5__565831 | M00073762C:D01 |
| 2180 | 35242 | 533.J04.beta5__567042 | M00075219D:H04 |
| 2181 | 35248 | 533.P04.beta5__567048 | M00075221B:F03 |
| 2182 | 35256 | 533.H16.beta5__567232 | M00075247A:C11 |
| 2183 | 35260 | 2496.E04.GZ43__364183 | M00075248B:E06 |
| 2184 | 35267 | 537.C04.beta5__569723 | M00074912B:A10 |
| 2185 | 35285 | 537.E16.beta5__569917 | M00074924B:H01 |
| 2186 | 35287 | 537.G16.beta5__569919 | M00074924D:C03 |
| 2187 | 35320 | 529.H17.beta5__565648 | M00074859D:H07 |
| 2188 | 35321 | 529.I17.beta5__565649 | M00073988D:F09 |
| 2189 | 35330 | 527.B05.beta5__564682 | M00073000C:A09 |
| 2190 | 35342 | 2472.B03.GZ43__360876 | M00074327C:C03 |
| 2191 | 35344 | 527.P05.beta5__564696 | M00074328A:B01 |
| 2192 | 35347 | 2540.P01.GZ43__372368 | M00073813D:A12 |
| 2193 | 35349 | 527.E17.beta5__564877 | M00073813D:B06 |
| 2194 | 35355 | 527.K17.beta5__564883 | M00073814A:C01 |
| 2195 | 35357 | 527.M17.beta5__564885 | M00073814C:B04 |
| 2196 | 35360 | 2472.J07.GZ43__361072 | M00074358B:H11 |
| 2197 | 35396 | 535.D05.beta5__568588 | M00073830A:C02 |
| 2198 | 35403 | 535.K05.beta5__568595 | M00075559B:F11 |
| 2199 | 35405 | 535.M05.beta5__568597 | M00075584C:F03 |
| 2200 | 35434 | 532.J05.beta5__566674 | M00074645A:D05 |
| 2201 | 35438 | 2481.G06.GZ43__359037 | M00074646B:E09 |
| 2202 | 35455 | 532.O17.beta5__566871 | M00075187A:D04 |
| 2203 | 35460 | 531.D05.beta5__566284 | M00074437B:F04 |
| 2204 | 35462 | 531.F05.beta5__566286 | M00074390A:A07 |
| 2205 | 35468 | 531.L05.beta5__566292 | M00074406C:D02 |
| 2206 | 35469 | 531.M05.beta5__566293 | M00074460B:G08 |
| 2207 | 35474 | 531.B17.beta5__566474 | M00074416A:B04 |

TABLE 15-continued

| SEQ ID NO | Spot Id | Sequence Name | Sample Name or Clone Name |
|---|---|---|---|
| 2208 | 35483 | 531.K17.beta5__566483 | M00074500D:D01 |
| 2209 | 35485 | 531.M17.beta5__566485 | M00074501A:G07 |
| 2210 | 35486 | 531.N17.beta5__566486 | M00074443D:D10 |
| 2211 | 35524 | 534.D05.beta5__567820 | M00073720B:B08 |
| 2212 | 35532 | 534.L05.beta5__567828 | M00073722D:G11 |
| 2213 | 35569 | 530.A17.beta5__566025 | M00073003D:F02 |
| 2214 | 35579 | 2505.E11.GZ43__366280 | M00073006B:D05 |
| 2215 | 35608 | 533.H17.beta5__567248 | M00073866D:G02 |
| 2216 | 35612 | 533.L17.beta5__567252 | M00073867A:F07 |
| 2217 | 35622 | 537.F05.beta5__569742 | M00073048C:G12 |
| 2218 | 35624 | 537.H05.beta5__569744 | M00073049A:H04 |
| 2219 | 35626 | 2510.N13.GZ43__369350 | M00073049B:B03 |
| 2220 | 35632 | 537.P05.beta5__569752 | M00073049C:F01 |
| 2221 | 35633 | 2536.A09.GZ43__370480 | M00073603C:C02 |
| 2222 | 35640 | 537.H17.beta5__569936 | M00074284B:B03 |
| 2223 | 35656 | 529.H06.beta5__565472 | M00074120A:D10 |
| 2224 | 35668 | 529.D18.beta5__565660 | M00074145B:C04 |
| 2225 | 35670 | 529.F18.beta5__565662 | M00074146C:D12 |
| 2226 | 35676 | 2561.O08.GZ43__376575 | M00074148A:C01 |
| 2227 | 35678 | 2561.O09.GZ43__376576 | M00074148A:G12 |
| 2228 | 35682 | 527.B06.beta5__564698 | M00074084D:F11 |
| 2229 | 35688 | 527.H06.beta5__564704 | M00074085B:E06 |
| 2230 | 35689 | 2457.C17.GZ43__356277 | M00074201A:D12 |
| 2231 | 35694 | 527.N06.beta5__564710 | M00074086A:G02 |
| 2232 | 35702 | 527.F18.beta5__564894 | M00074098C:B09 |
| 2233 | 35703 | 527.G18.beta5__564895 | M00074215D:E01 |
| 2234 | 35730 | 2456.K07.GZ43__356075 | M00074179C:B01 |
| 2235 | 35733 | 2475.L12.GZ43__352277 | M00074556C:F07 |
| 2236 | 35735 | 536.H17.beta5__569168 | M00074556D:F07 |
| 2237 | 35743 | 536.P17.beta5__569176 | M00074557C:C12 |
| 2238 | 35780 | 2542.P15.GZ43__373150 | M00073907A:D03 |
| 2239 | 35790 | 532.N06.beta5__566694 | M00073908C:C08 |
| 2240 | 35792 | 532.P06.beta5__566696 | M00073908C:D09 |
| 2241 | 35798 | 2555.G05.GZ43__373308 | M00073919B:D07 |
| 2242 | 35803 | 532.K18.beta5__566883 | M00074904A:H09 |
| 2243 | 35812 | 2459.L07.GZ43__357263 | M00074304B:C09 |
| 2244 | 35813 | 531.E06.beta5__566301 | M00074698D:D01 |
| 2245 | 35818 | 531.J06.beta5__566306 | M00074304D:D07 |
| 2246 | 35820 | 531.L06.beta5__566308 | M00074304D:G12 |
| 2247 | 35825 | 2482.K23.GZ43__359534 | M00074722C:A04 |
| 2248 | 35907 | 530.C06.beta5__565851 | M00073763C:D03 |
| 2249 | 35912 | 2498.G11.GZ43__365006 | M00075439B:B12 |
| 2250 | 35914 | 530.J06.beta5__565858 | M00075441D:E10 |
| 2251 | 35934 | 530.N18.beta5__566054 | M00075494A:E02 |
| 2252 | 35968 | 2496.G14.GZ43__364241 | M00075255A:F10 |
| 2253 | 35985 | 2466.F18.GZ43__360219 | M00074927B:E02 |
| 2254 | 35987 | 2466.F22.GZ43__360223 | M00074927C:C07 |
| 2255 | 36016 | 529.P07.beta5__565496 | M00074852B:E04 |
| 2256 | 36025 | 529.I19.beta5__565681 | M00073994B:D01 |
| 2257 | 36026 | 529.J19.beta5__565682 | M00074863C:F07 |
| 2258 | 36043 | 527.K07.beta5__564723 | M00073804A:C10 |
| 2259 | 36045 | 2540.J12.GZ43__372235 | M00073804B:E02 |
| 2260 | 36055 | 527.G19.beta5__564911 | M00073816B:E11 |
| 2261 | 36057 | 527.I19.beta5__564913 | M00073816C:G07 |
| 2262 | 36058 | 527.J19.beta5__564914 | M00074359D:B10 |
| 2263 | 36065 | 2367.F17.GZ43__346131 | M00073457C:B05 |
| 2264 | 36075 | 536.L08.beta5__569028 | M00073462D:D11 |
| 2265 | 36085 | 2367.K13.GZ43__346247 | M00073474C:F08 |
| 2266 | 36089 | 536.J20.beta5__569218 | M00073475B:E12 |
| 2267 | 36099 | 2511.I14.GZ43__369615 | M00075567B:A03 |
| 2268 | 36102 | 2541.I21.GZ43__372604 | M00073832A:F12 |
| 2269 | 36103 | 2511.J11.GZ43__369636 | M00075559D:F05 |
| 2270 | 36114 | 535.B19.beta5__568810 | M00073846B:B01 |
| 2271 | 36125 | 535.M19.beta5__568821 | M00075640C:C05 |
| 2272 | 36131 | 532.C07.beta5__566699 | M00075137C:H04 |
| 2273 | 36143 | 532.O07.beta5__566711 | M00075161D:D08 |
| 2274 | 36157 | 532.M19.beta5__566901 | M00075191D:G11 |
| 2275 | 36162 | 531.B07.beta5__566314 | M00074415C:G02 |
| 2276 | 36165 | 2474.E09.GZ43__361722 | M00074461D:E04 |
| 2277 | 36174 | 2473.C15.GZ43__361296 | M00074420B:H05 |
| 2278 | 36175 | 2474.F14.GZ43__361751 | M00074465B:E06 |
| 2279 | 36180 | 531.D19.beta5__566508 | M00074395A:C03 |
| 2280 | 36236 | 534.L07.beta5__567860 | M00073730B:A06 |
| 2281 | 36255 | 2542.K06.GZ43__373021 | M00073892A:G06 |
| 2282 | 36262 | 530.F07.beta5__565870 | M00074228D:H10 |
| 2283 | 36268 | 530.L07.beta5__565876 | M00074230A:D01 |

TABLE 15-continued

| SEQ ID NO | Spot Id | Sequence Name | Sample Name or Clone Name |
|---|---|---|---|
| 2284 | 36273 | 530.A19.beta5__566057 | M00073006D:E04 |
| 2285 | 36276 | 2458.H07.GZ43__356783 | M00074248C:E12 |
| 2286 | 36285 | 2505.G06.GZ43__366323 | M00073009B:C08 |
| 2287 | 36312 | 533.H19.beta5__567280 | M00073867D:F10 |
| 2288 | 36313 | 2467.H15.GZ43__360648 | M00074980D:C01 |
| 2289 | 36314 | 533.J19.beta5__567282 | M00073868A:D02 |
| 2290 | 36320 | 533.P19.beta5__567288 | M00073868B:H11 |
| 2291 | 36321 | 2535.L05.GZ43__370356 | M00073590D:C01 |
| 2292 | 36346 | 537.J19.beta5__569970 | M00074287D:G09 |
| 2293 | 36352 | 537.P19.beta5__569976 | M00074288A:F11 |
| 2294 | 36360 | 529.H08.beta5__565504 | M00074122D:H01 |
| 2295 | 36377 | 529.I20.beta5__565697 | M00074025A:F06 |
| 2296 | 36380 | 529.L20.beta5__565700 | M00074151C:C06 |
| 2297 | 36387 | 2457.D13.GZ43__356297 | M00074202B:F08 |
| 2298 | 36392 | 527.H08.beta5__564736 | M00074087B:C09 |
| 2299 | 36398 | 2560.G18.GZ43__375241 | M00074087C:G05 |
| 2300 | 36410 | 527.J20.beta5__564930 | M00074102A:G02 |
| 2301 | 36414 | 2560.O16.GZ43__375431 | M00074102B:D02 |
| 2302 | 36428 | 536.K07.beta5__569011 | M00074170D:D12 |
| 2303 | 36438 | 2456.M06.GZ43__356122 | M00074184D:B01 |
| 2304 | 36446 | 536.M19.beta5__569205 | M00074187C:G10 |
| 2305 | 36449 | 535.A08.beta5__568633 | M00074582D:B09 |
| 2306 | 36454 | 535.F08.beta5__568638 | M00073505A:G06 |
| 2307 | 36467 | 535.C20.beta5__568827 | M00074619D:F03 |
| 2308 | 36469 | 535.E20.beta5__568829 | M00074620A:F03 |
| 2309 | 36481 | 532.A08.beta5__566713 | M00074886B:G06 |
| 2310 | 36483 | 2465.F22.GZ43__358206 | M00074886B:H08 |
| 2311 | 36484 | 532.D08.beta5__566716 | M00073909C:B03 |
| 2312 | 36490 | 532.J08.beta5__566722 | M00073911B:G10 |
| 2313 | 36497 | 532.A20.beta5__566905 | M00074904C:G12 |
| 2314 | 36505 | 2465.L22.GZ43__358350 | M00074905D:A01 |
| 2315 | 36506 | 2555.H13.GZ43__373340 | M00073921A:B03 |
| 2316 | 36508 | 532.L20.beta5__566916 | M00073921B:F09 |
| 2317 | 36510 | 532.N20.beta5__566918 | M00073922B:B12 |
| 2318 | 36520 | 531.H08.beta5__566336 | M00074308B:D08 |
| 2319 | 36535 | 2482.M06.GZ43__359565 | M00074726C:G03 |
| 2320 | 36537 | 531.I20.beta5__566529 | M00074727B:D05 |
| 2321 | 36635 | 530.K20.beta5__566083 | M00073790A:A12 |
| 2322 | 36638 | 530.N20.beta5__566086 | M00075489C:D01 |
| 2323 | 36648 | 533.H08.beta5__567104 | M00075229D:H01 |
| 2324 | 36662 | 2496.G19.GZ43__364246 | M00075255D:F11 |
| 2325 | 36681 | 537.I08.beta5__569793 | M00074914D:G01 |
| 2326 | 36689 | 2466.G14.GZ43__360239 | M00074928D:C11 |
| 2327 | 36696 | 537.H20.beta5__569984 | M00074773B:B08 |
| 2328 | 36701 | 2466.H09.GZ43__360258 | M00074929D:F03 |
| 2329 | 36704 | 537.P20.beta5__569992 | M00074773C:G04 |
| 2330 | 36707 | 529.C09.beta5__565515 | M00073979B:B05 |
| 2331 | 36713 | 529.I09.beta5__565521 | M00073979C:G07 |
| 2332 | 36714 | 529.J09.beta5__565522 | M00074853A:B10 |
| 2333 | 36715 | 529.K09.beta5__565523 | M00073980A:E06 |
| 2334 | 36717 | 2557.H23.GZ43__374118 | M00073980B:H11 |
| 2335 | 36718 | 2464.L10.GZ43__357954 | M00074853C:C08 |
| 2336 | 36726 | 529.F21.beta5__565710 | M00074865A:F05 |
| 2337 | 36730 | 529.J21.beta5__565714 | M00074866A:G12 |
| 2338 | 36741 | 2540.K07.GZ43__372254 | M00073806B:H03 |
| 2339 | 36756 | 2472.K12.GZ43__361101 | M00074361B:G05 |
| 2340 | 36768 | 2472.L16.GZ43__361129 | M00074366A:H07 |
| 2341 | 36781 | 2367.H05.GZ43__346167 | M00073465D:E09 |
| 2342 | 36783 | 2367.H06.GZ43__346168 | M00073465D:G02 |
| 2343 | 36785 | 536.B22.beta5__569242 | M00073480A:D03 |
| 2344 | 36795 | 2367.M04.GZ43__346286 | M00073482B:H04 |
| 2345 | 36799 | 2367.M14.GZ43__346296 | M00073484B:A05 |
| 2346 | 36804 | 535.D09.beta5__568652 | M00073834D:H06 |
| 2347 | 36805 | 535.E09.beta5__568653 | M00075586A:G06 |
| 2348 | 36808 | 535.H09.beta5__568656 | M00073836D:E05 |
| 2349 | 36813 | 535.M09.beta5__568661 | M00075601A:E09 |
| 2350 | 36822 | 535.F21.beta5__568846 | M00073849A:H07 |
| 2351 | 36826 | 535.J21.beta5__568850 | M00073849C:D11 |
| 2352 | 36833 | 532.A09.beta5__566729 | M00075097C:C10 |
| 2353 | 36859 | 532.K21.beta5__566931 | M00075199D:D11 |
| 2354 | 36860 | 2482.A10.GZ43__359281 | M00074682A:D04 |
| 2355 | 36865 | 531.A09.beta5__566345 | M00074465B:H12 |
| 2356 | 36867 | 531.C09.beta5__566347 | M00074465C:E10 |
| 2357 | 36875 | 531.K09.beta5__566355 | M00074468C:A04 |
| 2358 | 36883 | 2474.O20.GZ43__361973 | M00074510B:A11 |
| 2359 | 36895 | 531.O21.beta5__566551 | M00074513A:F05 |

TABLE 15-continued

| SEQ ID NO | Spot Id | Sequence Name | Sample Name or Clone Name |
|---|---|---|---|
| 2360 | 36934 | 2554.I07.GZ43__376046 | M00073732A:G02 |
| 2361 | 36937 | 2542.D20.GZ43__372867 | M00073880B:G01 |
| 2362 | 36939 | 534.K09.beta5__567891 | M00073881C:A01 |
| 2363 | 36942 | 2554.I17.GZ43__376056 | M00073733A:C03 |
| 2364 | 36944 | 2554.J10.GZ43__376073 | M00073735B:B11 |
| 2365 | 36956 | 534.L21.beta5__568084 | M00073753C:A02 |
| 2366 | 36960 | 534.P21.beta5__568088 | M00073754B:D03 |
| 2367 | 36963 | 2504.P01.GZ43__366150 | M00072977D:F11 |
| 2368 | 36966 | 530.F09.beta5__565902 | M00074230C:F02 |
| 2369 | 36967 | 2504.P17.GZ43__366166 | M00072978B:C07 |
| 2370 | 36976 | 2458.A21.GZ43__356629 | M00074231C:G02 |
| 2371 | 36989 | 2505.H18.GZ43__366359 | M00073012C:C08 |
| 2372 | 36990 | 530.N21.beta5__566102 | M00074256A:D06 |
| 2373 | 36999 | 533.G09.beta5__567119 | M00074958A:E09 |
| 2374 | 37011 | 533.C21.beta5__567307 | M00072951D:B02 |
| 2375 | 37017 | 533.I21.beta5__567313 | M00072953C:G08 |
| 2376 | 37018 | 2506.N09.GZ43__366878 | M00073869C:A02 |
| 2377 | 37023 | 2467.I24.GZ43__360681 | M00072981D:F06 |
| 2378 | 37027 | 537.C09.beta5__569803 | M00073594A:C01 |
| 2379 | 37035 | 537.K09.beta5__569811 | M00073595A:A10 |
| 2380 | 37046 | 537.F21.beta5__569998 | M00074290C:B05 |
| 2381 | 37049 | 2536.E11.GZ43__370578 | M00073616A:F06 |
| 2382 | 37053 | 2536.E23.GZ43__370590 | M00073617B:F03 |
| 2383 | 37054 | 2459.H03.GZ43__357163 | M00074293B:H08 |
| 2384 | 37056 | 537.P21.beta5__570008 | M00074293C:G09 |
| 2385 | 37062 | 529.F10.beta5__565534 | M00074131A:H09 |
| 2386 | 37065 | 529.I10.beta5__565537 | M00074014B:C11 |
| 2387 | 37072 | 529.P10.beta5__565544 | M00074132C:F10 |
| 2388 | 37073 | 529.A22.beta5__565721 | M00074026C:C06 |
| 2389 | 37085 | 2558.M22.GZ43__374621 | M00074027D:G03 |
| 2390 | 37087 | 529.O22.beta5__565735 | M00074028C:C04 |
| 2391 | 37088 | 529.P22.beta5__565736 | M00074156B:E07 |
| 2392 | 37103 | 2457.E24.GZ43__356332 | M00074206A:H12 |
| 2393 | 37108 | 2560.O19.GZ43__375434 | M00074102C:E01 |
| 2394 | 37109 | 527.E22.beta5__564957 | M00074218C:B12 |
| 2395 | 37125 | 536.F09.beta5__569038 | M00074535D:H03 |
| 2396 | 37130 | 2456.G16.GZ43__355988 | M00074172C:D05 |
| 2397 | 37136 | 536.O09.beta5__569047 | M00074174A:C02 |
| 2398 | 37144 | 536.G21.beta5__569231 | M00074191B:B05 |
| 2399 | 37146 | 2456.O10.GZ43__356174 | M00074191C:D08 |
| 2400 | 37149 | 536.N21.beta5__569238 | M00074561D:D12 |
| 2401 | 37152 | 536.O21.beta5__569239 | M00074192C:C10 |
| 2402 | 37162 | 2368.C09.GZ43__346435 | M00073512B:E12 |
| 2403 | 37172 | 535.D22.beta5__568860 | M00073530B:A02 |
| 2404 | 37176 | 535.H22.beta5__568864 | M00073531B:H02 |
| 2405 | 37215 | 532.O22.beta5__566951 | M00074906C:H07 |
| 2406 | 37218 | 531.B10.beta5__566362 | M00074310D:B04 |
| 2407 | 37220 | 531.D10.beta5__566364 | M00074310D:D02 |
| 2408 | 37243 | 2482.N14.GZ43__359597 | M00074730D:F06 |
| 2409 | 37248 | 2464.F24.GZ43__357824 | M00074839D:A04 |
| 2410 | 37315 | 530.C10.beta5__565915 | M00073768B:D10 |
| 2411 | 37322 | 530.J10.beta5__565922 | M00075425C:G02 |
| 2412 | 37324 | 2498.K17.GZ43__365108 | M00075454D:A11 |
| 2413 | 37330 | 530.B22.beta5__566106 | M00075498C:B11 |
| 2414 | 37336 | 2507.L15.GZ43__367220 | M00075501A:F10 |
| 2415 | 37346 | 2491.O22.GZ43__363954 | M00075231D:D09 |
| 2416 | 37379 | 537.C10.beta5__569819 | M00074916C:H10 |
| 2417 | 37381 | 537.E10.beta5__569821 | M00074916D:B12 |
| 2418 | 37397 | 537.E22.beta5__570013 | M00074930B:D04 |
| 2419 | 37398 | 537.F22.beta5__570014 | M00074774A:D03 |
| 2420 | 37401 | 2466.H22.GZ43__360271 | M00074932A:F01 |
| 2421 | 37431 | 529.G23.beta5__565743 | M00074001D:G02 |
| 2422 | 37433 | 529.I23.beta5__565745 | M00074002A:D11 |
| 2423 | 37434 | 529.J23.beta5__565746 | M00074869D:D08 |
| 2424 | 37437 | 529.M23.beta5__565749 | M00074002B:E10 |
| 2425 | 37438 | 529.N23.beta5__565750 | M00074870B:C05 |
| 2426 | 37447 | 527.G11.beta5__564783 | M00073808C:H06 |
| 2427 | 37457 | 527.A23.beta5__564969 | M00073819A:A12 |
| 2428 | 37467 | 527.K23.beta5__564979 | M00073819C:F05 |
| 2429 | 37469 | 527.M23.beta5__564981 | M00073819D:A05 |
| 2430 | 37479 | 2367.H19.GZ43__346181 | M00073468A:G03 |
| 2431 | 37510 | 2541.L10.GZ43__372665 | M00073838C:F02 |
| 2432 | 37522 | 2506.C08.GZ43__366613 | M00073850A:H09 |
| 2433 | 37528 | 2506.C14.GZ43__366619 | M00073850D:A03 |
| 2434 | 37532 | 535.L23.beta5__568884 | M00073851A:C04 |
| 2435 | 37551 | 532.O11.beta5__566775 | M00075165D:B06 |

TABLE 15-continued

| SEQ ID NO | Spot Id | Sequence Name | Sample Name or Clone Name |
|---|---|---|---|
| 2436 | 37561 | 2491.I06.GZ43__363794 | M00075203A:G06 |
| 2437 | 37575 | 531.G11.beta5__566383 | M00074473B:A09 |
| 2438 | 37579 | 531.K11.beta5__566387 | M00074474D:F08 |
| 2439 | 37581 | 531.M11.beta5__566389 | M00074476A:A06 |
| 2440 | 37584 | 531.P11.beta5__566392 | M00074441B:A02 |
| 2441 | 37591 | 2474.P14.GZ43__361991 | M00074514A:E08 |
| 2442 | 37592 | 531.H23.beta5__566576 | M00074425C:E05 |
| 2443 | 37595 | 531.K23.beta5__566579 | M00074515A:E02 |
| 2444 | 37597 | 531.M23.beta5__566581 | M00074515A:G08 |
| 2445 | 37637 | 534.E11.beta5__567917 | M00073884A:D12 |
| 2446 | 37638 | 534.F11.beta5__567918 | M00073735C:E04 |
| 2447 | 37660 | 534.L23.beta5__568116 | M00073757A:G10 |
| 2448 | 37662 | 534.N23.beta5__568118 | M00073757C:B09 |
| 2449 | 37667 | 2505.A09.GZ43__366182 | M00072979C:F02 |
| 2450 | 37677 | 530.M11.beta5__565941 | M00072980B:C06 |
| 2451 | 37680 | 2458.C03.GZ43__356659 | M00074234B:B05 |
| 2452 | 37682 | 2458.L01.GZ43__356873 | M00074256D:D03 |
| 2453 | 37688 | 2458.L05.GZ43__356877 | M00074258A:G05 |
| 2454 | 37692 | 530.L23.beta5__566132 | M00074258B:F07 |
| 2455 | 37702 | 2506.I05.GZ43__366754 | M00073861B:C11 |
| 2456 | 37707 | 533.K11.beta5__567155 | M00074960C:H09 |
| 2457 | 37715 | 2467.J18.GZ43__360699 | M00072983C:F04 |
| 2458 | 37724 | 533.L23.beta5__567348 | M00073870A:E04 |
| 2459 | 37729 | 537.A11.beta5__569833 | M00073595D:H05 |
| 2460 | 37731 | 2535.N11.GZ43__370410 | M00073596B:B12 |
| 2461 | 37734 | 2459.A22.GZ43__357014 | M00074274D:F10 |
| 2462 | 37735 | 537.G11.beta5__569839 | M00073597A:A03 |
| 2463 | 37743 | 2535.O02.GZ43__370425 | M00073597D:H01 |
| 2464 | 37748 | 537.D23.beta5__570028 | M00074293D:H07 |
| 2465 | 37760 | 537.P23.beta5__570040 | M00074296B:B11 |
| 2466 | 37764 | 529.D12.beta5__565564 | M00074134A:E08 |
| 2467 | 37768 | 2561.K01.GZ43__376472 | M00074135A:F02 |
| 2468 | 37794 | 527.B12.beta5__564794 | M00074089D:E03 |
| 2469 | 37805 | 527.M12.beta5__564805 | M00074208B:F09 |
| 2470 | 37826 | 2456.H06.GZ43__356002 | M00074174B:H08 |
| 2471 | 37827 | 2475.H07.GZ43__362176 | M00074540C:E02 |
| 2472 | 37831 | 536.H11.beta5__569072 | M00074541C:E08 |
| 2473 | 37834 | 536.I11.beta5__569073 | M00074175A:D08 |
| 2474 | 37859 | 535.C12.beta5__568699 | M00074594B:A07 |
| 2475 | 37861 | 535.E12.beta5__568701 | M00074594B:E10 |
| 2476 | 37865 | 2480.I08.GZ43__358703 | M00074596D:B12 |
| 2477 | 37868 | 535.L12.beta5__568708 | M00073514A:G01 |
| 2478 | 37874 | 2368.H23.GZ43__346569 | M00073532C:H12 |
| 2479 | 37877 | 2481.B11.GZ43__358922 | M00074633B:H01 |
| 2480 | 37882 | 535.J24.beta5__568898 | M00073537D:C03 |
| 2481 | 37887 | 2481.C09.GZ43__358944 | M00074635B:C07 |
| 2482 | 37895 | 2465.H15.GZ43__358247 | M00074890B:C01 |
| 2483 | 37897 | 2465.H17.GZ43__358249 | M00074890B:D05 |
| 2484 | 37914 | 532.J24.beta5__566978 | M00073925B:A01 |
| 2485 | 37926 | 531.F12.beta5__566398 | M00074315C:F09 |
| 2486 | 37929 | 531.I12.beta5__566401 | M00074713B:F02 |
| 2487 | 37947 | 531.K24.beta5__566595 | M00074735C:A11 |
| 2488 | 37951 | 531.O24.beta5__566599 | M00074735D:G06 |
| 2489 | 38020 | 2498.M13.GZ43__365152 | M00075444D:F05 |
| 2490 | 38022 | 2498.M15.GZ43__365154 | M00075448D:A02 |
| 2491 | 38026 | 530.J12.beta5__565954 | M00075414D:G01 |
| 2492 | 38029 | 2565.N09.GZ43__398087 | M00073773D:B10 |
| 2493 | 38048 | 530.P24.beta5__566152 | M00075474C:G02 |
| 2494 | 38050 | 2496.A04.GZ43__364087 | M00075235C:E03 |
| 2495 | 38068 | 533.D24.beta5__567356 | M00075283A:F04 |
| 2496 | 38074 | 533.J24.beta5__567362 | M00075285D:A02 |
| 2497 | 38083 | 2466.C04.GZ43__360133 | M00074918B:F03 |
| 2498 | 38089 | 2466.C16.GZ43__360145 | M00074919C:D12 |
| 2499 | 38091 | 2466.C22.GZ43__360151 | M00074919D:H09 |
| 2500 | 38096 | 537.P12.beta5__569864 | M00074754C:G02 |
| 2501 | 38101 | 537.E24.beta5__570045 | M00074935A:D06 |
| 2502 | 38103 | 537.G24.beta5__570047 | M00074935B:C06 |
| 2503 | 38107 | 537.K24.beta5__570051 | M00074935C:E08 |
| 2504 | 38110 | 537.N24.beta5__570054 | M00074782B:F01 |
| 2505 | 38112 | 537.P24.beta5__570056 | M00074783B:B11 |

Table 16 (on a CD ROM filed herewith) provides the results for gene products expressed by at least 2-fold or greater in the prostate tumor samples relative to normal tissue samples in at least 20% of the patients tested. Table 16 includes: 1) the spot identification number ("Spot ID"); 2) the GenBank Accession Number of the publicly available sequence corresponding to the polynucleotide ("GenBankHit"); 3) a description of the GenBank sequence ("GenBankDesc"); 4) the score of the similarity of the polynucleotide sequence and the GenBank sequence ("GenBankScore"); 5) the number of patients analyzed; 6) the percentage of patients tested in which expression levels (e.g., as message level) of the gene was at least 2-fold greater in cancerous tissue than in matched normal tissue (">=2x"); 7) the percentage of patients tested in which expression levels (e.g., as message level) of the gene was at least 5-fold greater in cancerous tissue than in matched normal tissue (">=5x"); and 8) the percentage of patients tested in which expression levels (e.g., as message level) of the gene was less than or equal to ½ of the expression level in matched normal cells ("<=halfx").

Table 17 (on a CD ROM filed herewith) provides the results for gene products in which expression levels of the gene in prostate tumor cells was less than or equal to ½ of the expression level in normal tissue samples in at least 20% of the patients tested. Table 17 includes: 1) the spot identification number ("Spot ID"); 2) the GenBank Accession Number of the publicly available sequence corresponding to the polynucleotide ("GenBankHit"); 3) a description of the GenBank sequence ("GenBankDesc"); 4) the score of the similarity of the polynucleotide sequence and the GenBank sequence ("GenBankScore"); 5) the number of patients analyzed; 6) the percentage of patients tested in which expression levels (e.g., as message level) of the gene was at least 2-fold greater in cancerous tissue than in matched normal tissue (">=2x"); 7) the percentage of patients tested in which expression levels (e.g., as message level) of the gene was at least 5-fold greater in cancerous tissue than in matched normal tissue (">=5x"); and 8) the percentage of patients tested in which expression levels (e.g., as message level) of the gene was less than or equal to ½ of the expression level in matched normal cells ("<=halfx").

Tables 16 and 17 also include the results from each patient, identified by the patient ID number (e.g., 93). This data represents the ratio of differential expression for the samples tested from that particular patient's tissues (e.g., "93" is the ratio from the tissue samples of patient ID no. 93). The ratios of differential expression are expressed as a normalized hybridization signal associated with the tumor probe divided by the normalized hybridization signal with the normal probe. Thus, a ratio greater than 1 indicates that the gene product is increased in expression in cancerous cells relative to normal cells, while a ratio of less than 1 indicates the opposite.

These data provide evidence that the genes represented by the polynucleotides having the indicated sequences are differentially expressed in prostate cancer as compared to normal non-cancerous prostate tissue.

Example 21

Antisense Regulation of Gene Expression

The expression of the differentially expressed genes represented by the polynucleotides in the cancerous cells can be analyzed using antisense knockout technology to confirm the role and function of the gene product in tumorigenesis, e.g., in promoting a metastatic phenotype.

A number of different oligonucleotides complementary to the mRNA generated by the differentially expressed genes identified herein can be designed as potential antisense oligonucleotides, and tested for their ability to suppress expression of the genes. Sets of antisense oligomers specific to each candidate target are designed using the sequences of the polynucleotides corresponding to a differentially expressed gene and the software program HYBsimulator Version 4 (available for Windows 95/Windows NT or for Power Macintosh, RNAture, Inc. 1003 Health Sciences Road, West, Irvine, Calif. 92612 USA). Factors that are considered when designing antisense oligonucleotides include: 1) the secondary structure of oligonucleotides; 2) the secondary structure of the target gene; 3) the specificity with no or minimum cross-hybridization to other expressed genes; 4) stability; 5) length and 6) terminal GC content. The antisense oligonucleotide is designed so that it will hybridize to its target sequence under conditions of high stringency at physiological temperatures (e.g., an optimal temperature for the cells in culture to provide for hybridization in the cell, e.g., about 37° C.), but with minimal formation of homodimers.

Using the sets of oligomers and the HYBsimulator program, three to ten antisense oligonucleotides and their reverse controls are designed and synthesized for each candidate mRNA transcript, which transcript is obtained from the gene corresponding to the target polynucleotide sequence of interest. Once synthesized and quantitated, the oligomers are screened for efficiency of a transcript knock-out in a panel of cancer cell lines. The efficiency of the knock-out is determined by analyzing mRNA levels using lightcycler quantification. The oligomers that resulted in the highest level of transcript knock-out, wherein the level was at least about 50%, preferably about 80-90%, up to 95% or more up to undetectable message, are selected for use in a cell-based proliferation assay, an anchorage independent growth assay, and an apoptosis assay.

The ability of each designed antisense oligonucleotide to inhibit gene expression is tested through transfection into LNCaP, PC3, 22Rv1, MDA-PCA-2b, or DU145 prostate carcinoma cells. For each transfection mixture, a carrier molecule (such as a lipid, lipid derivative, lipid-like molecule, cholesterol, cholesterol derivative, or cholesterol-like molecule) is prepared to a working concentration of 0.5 mM in water, sonicated to yield a uniform solution, and filtered through a 0.45 µm PVDF membrane. The antisense or control oligonucleotide is then prepared to a working concentration of 100 µM in sterile Millipore water. The oligonucleotide is further diluted in OptiMEM™ (Gibco/BRL), in a microfuge tube, to 2 µM, or approximately 20 µg oligo/mil of OptiMEM™. In a separate microfuge tube, the carrier molecule, typically in the amount of about 1.5-2 nmol carrier/µg antisense oligonucleotide, is diluted into the same volume of OptiMEM™ used to dilute the oligonucleotide. The diluted antisense oligonucleotide is immediately added to the diluted carrier and mixed by pipetting up and down. Oligonucleotide is added to the cells to a final concentration of 30 nM.

The level of target mRNA that corresponds to a target gene of interest in the transfected cells is quantitated in the cancer cell lines using the Roche LightCycler™ real-time PCR machine. Values for the target mRNA are normalized versus an internal control (e.g., beta-actin). For each 20 µl reaction, extracted RNA (generally 0.2-1 µg total) is placed into a sterile 0.5 or 1.5 ml microcentrifuge tube, and water is added to a total volume of 12.5 µl. To each tube is added 7.5 µl of a buffer/enzyme mixture, prepared by mixing (in the order listed) 2.5 µl H$_2$O, 2.0 µl 10× reaction buffer, 10 µl oligo dT (20 pmol), 1.0 µl dNTP mix (10 mM each), 0.5 µl RNAsin®

(20 u) (Ambion, Inc., Hialeah, Fla.), and 0.5 µl MMLV reverse transcriptase (50 u) (Ambion, Inc.). The contents are mixed by pipetting up and down, and the reaction mixture is incubated at 42° C. for 1 hour. The contents of each tube are centrifuged prior to amplification.

An amplification mixture is prepared by mixing in the following order: 1× PCR buffer II, 3 mM $MgCl_2$, 140 µM each dNTP, 0.175 pmol each oligo, 1:50,000 dil of SYBR® Green, 0.25 mg/ml BSA, 1 unit Taq polymerase, and $H_2O$ to 20 µl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 µl aliquot of amplification mixture, 2 µl of template RT is added, and amplification is carried out according to standard protocols. The results are expressed as the percent decrease in expression of the corresponding gene product relative to non-transfected cells, vehicle-only transfected (mock-transfected) cells, or cells transfected with reverse control oligonucleotides.

Example 22

Effect of Expression on Proliferation

The effect of gene expression on the inhibition of cell proliferation can be assessed in metastatic breast cancer cell lines (MDA-MB-231 ("231")); SW620 colon colorectal carcinoma cells; SKOV3 cells (a human ovarian carcinoma cell line); or LNCaP, PC3, 22Rv1, MDA-PCA-2b, or DU145 prostate cancer cells.

Cells are plated to approximately 60-80% confluency in 96-well dishes. Antisense or reverse control oligonucleotide is diluted to 2 µM in OptiMEM™. The oligonucleotide-OptiMEM™ can then be added to a delivery vehicle, which delivery vehicle can be selected so as to be optimized for the particular cell type to be used in the assay. The oligo/delivery vehicle mixture is then further diluted into medium with serum on the cells. The final concentration of oligonucleotide for all experiments can be about 300 nM.

Antisense oligonucleotides are prepared as described above (see Example 21). Cells are transfected overnight at 37° C. and the transfection mixture is replaced with fresh medium the next morning. Transfection is carried out as described above in Example 21.

Those antisense oligonucleotides that result in inhibition of proliferation of SW620 cells indicate that the corresponding gene plays a role in production or maintenance of the cancerous phenotype in cancerous colon cells. Those antisense oligonucleotides that inhibit proliferation in SKOV3 cells represent genes that play a role in production or maintenance of the cancerous phenotype in cancerous breast cells. Those antisense oligonucleotides that result in inhibition of proliferation of MDA-MB-231 cells indicate that the corresponding gene plays a role in production or maintenance of the cancerous phenotype in cancerous ovarian cells. Those antisense oligonucleotides that inhibit proliferation in LNCaP, PC3, 22Rv1, MDA-PCA-2b, or DU145 cells represent genes that play a role in production or maintenance of the cancerous phenotype in cancerous prostate cells.

Example 23

Effect of Gene Expression on Cell Migration

The effect of gene expression on the inhibition of cell migration can be assessed in LNCaP, PC3, 22Rv1, MDA-PCA-2b, or DU145 prostate cancer cells using static endothelial cell binding assays, non-static endothelial cell binding assays, and transmigration assays.

For the static endothelial cell binding assay, antisense oligonucleotides are prepared as described above (see Example 21). Two days prior to use, prostate cancer cells (CaP) are plated and transfected with antisense oligonucleotide as described above (see Examples 21 and 22). On the day before use, the medium is replaced with fresh medium, and on the day of use, the medium is replaced with fresh medium containing 2 µM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in DMEM/1% BSA/10 mM HEPES pH 7.0. Finally, CaP cells are counted and resuspended at a concentration of $1 \times 10^6$ cells/ml.

Endothelial cells (EC) are plated onto 96-well plates at 40-50% confluence 3 days prior to use. On the day of use, EC are washed 1× with PBS and 50λ DMDM/1% BSA/10 mM HEPES pH 7 is added to each well. To each well is then added 50K (50λ) CaP cells in DMEM/1% BSA/10 mM HEPES pH 7. The plates are incubated for an additional 30 min and washed 5× with PBS containing $Ca^{++}$ and $Mg^{++}$. After the final wash, 100 µL PBS is added to each well and fluorescence is read on a fluorescent plate reader (Ab492/Em 516 nm).

For the non-static endothelial cell binding assay, CaP are prepared as described above. EC are plated onto 24-well plates at 30-40% confluence 3 days prior to use. On the day of use, a subset of EC are treated with cytokine for 6 hours then washed 2× with PBS. To each well is then added 150-200K CaP cells in DMEM/1% BSA/10 mM HEPES pH 7. Plates are placed on a rotating shaker (70 RPM) for 30 min and then washed 3× with PBS containing $Ca^{++}$ and $Mg^{++}$. After the final wash, 500 µL PBS is added to each well and fluorescence is read on a fluorescent plate reader (Ab492/Em 516 nm).

For the transmigration assay, CaP are prepared as described above with the following changes. On the day of use, CaP medium is replaced with fresh medium containing 5 µM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in EGM-2-MV medium. Finally, CaP cells are counted and resuspended at a concentration of $1 \times 10^6$ cells/ml.

EC are plated onto FluorBlok transwells (BD Biosciences) at 30-40% confluence 5-7 days before use. Medium is replaced with fresh medium 3 days before use and on the day of use. To each transwell is then added 50K labeled CaP. 30 min prior to the first fluorescence reading, 10 µg of FITC-dextran (10K MW) is added to the EC plated filter. Fluorescence is then read at multiple time points on a fluorescent plate reader (Ab492/Em 516 nm).

Those antisense oligonucleotides that result in inhibition of binding of LNCaP, PC3, 22Rv1, MDA-PCA-2b, or DU145 prostate cancer cells to endothelial cells indicate that the corresponding gene plays a role in the production or maintenance of the cancerous phenotype in cancerous prostate cells.

Those antisense oligonucleotides that result in inhibition of endothelial cell transmigration by LNCaP, PC3, 22Rv1, MDA-PCA-2b, or DU145 prostate cancer cells indicate that the corresponding gene plays a role in the production or maintenance of the cancerous phenotype in cancerous prostate cells.

Example 24

Effect of Gene Expression on Colony Formation

The effect of gene expression upon colony formation of SW620 cells, SKOV3 cells, MD-MBA-231 cells, LNCaP cells, PC3 cells, 22Rv1 cells, MDA-PCA-2b cells, and DU145 cells can be tested in a soft agar assay. Soft agar assays are conducted by first establishing a bottom layer of 2 ml of 0.6% agar in media plated fresh within a few hours of layering on the cells. The cell layer is formed on the bottom layer by removing cells transfected as described above from plates using 0.05% trypsin and washing twice in media. The cells are counted in a Coulter counter, and resuspended to $10^6$ per ml in media. 10 µl aliquots are placed with media in 96-well plates (to check counting with WST1), or diluted further for the soft agar assay. 2000 cells are plated in 800 µl 0.4% agar in duplicate wells above 0.6% agar bottom layer. After the cell layer agar solidifies, 2 ml of media is dribbled on top and antisense or reverse control oligo (produced as described above) is added without delivery vehicles. Fresh media and oligos are added every 3-4 days. Colonies form in 10 days to 3 weeks. Fields of colonies are counted by eye. Wst-1 metabolism values can be used to compensate for small differences in starting cell number. Larger fields can be scanned for visual record of differences.

Those antisense oligonucleotides that result in inhibition of colony formation of SW620 cells indicate that the corresponding gene plays a role in production or maintenance of the cancerous phenotype in cancerous colon cells. Those antisense oligonucleotides that inhibit colony formation in SKOV3 cells represent genes that play a role in production or maintenance of the cancerous phenotype in cancerous breast cells. Those antisense oligonucleotides that result in inhibition of colony formation of MDA-MB-231 cells indicate that the corresponding gene plays a role in production or maintenance of the cancerous phenotype in cancerous ovarian cells. Those antisense oligonucleotides that inhibit colony formation in LNCaP, PC3, 22Rv1, MDA-PCA-2b, or DU145 cells represent genes that play a role in production or maintenance of the cancerous phenotype in cancerous prostate cells.

Example 25

Induction of Cell Death Upon Depletion of Polypeptides by Depletion of mRNA ("Antisense Knockout")

In order to assess the effect of depletion of a target message upon cell death, LNCaP, PC3, 22Rv1, MDA-PCA-2b, or DU145 cells, or other cells derived from a cancer of interest, can be transfected for proliferation assays. For cytotoxic effect in the presence of cisplatin (cis), the same protocol is followed but cells are left in the presence of 2 µM drug. Each day, cytotoxicity is monitored by measuring the amount of LDH enzyme released in the medium due to membrane damage. The activity of LDH is measured using the Cytotoxicity Detection Kit from Roche Molecular Biochemicals. The data is provided as a ratio of LDH released in the medium vs. the total LDH present in the well at the same time point and treatment (rLDH/tLDH). A positive control using antisense and reverse control oligonucleotides for BCL2 (a known anti-apoptotic gene) is included; loss of message for BCL2 leads to an increase in cell death compared with treatment with the control oligonucleotide (background cytotoxicity due to transfection).

Example 26

Functional Analysis of Gene Products Differentially Expressed in Prostate Cancer in Patients The gene products of sequences of a gene differentially expressed in cancerous cells can be further analyzed to confirm the role and function of the gene product in tumorigenesis, e.g., in promoting or inhibiting development of a metastatic phenotype. For example, the function of gene products corresponding to genes identified herein can be assessed by blocking function of the gene products in the cell. For example, where the gene product is secreted or associated with a cell surface membrane, blocking antibodies can be generated and added to cells to examine the effect upon the cell phenotype in the context of, for example, the transformation of the cell to a cancerous, particularly a metastatic, phenotype. In order to generate antibodies, a clone corresponding to a selected gene product is selected, and a sequence that represents a partial or complete coding sequence is obtained. The resulting clone is expressed, the polypeptide produced isolated, and antibodies generated. The antibodies are then combined with cells and the effect upon tumorigenesis assessed.

Where the gene product of the differentially expressed genes identified herein exhibits sequence homology to a protein of known function (e.g., to a specific kinase or protease) and/or to a protein family of known function (e.g., contains a domain or other consensus sequence present in a protease family or in a kinase family), then the role of the gene product in tumorigenesis, as well as the activity of the gene product, can be examined using small molecules that inhibit or enhance function of the corresponding protein or protein family.

Additional functional assays include, but are not necessarily limited to, those that analyze the effect of expression of the corresponding gene upon cell cycle and cell migration. Methods for performing such assays are well known in the art.

Example 27

Contig Assembly and Additional Gene Characterization

The sequences of the polynucleotides provided in the present invention can be used to extend the sequence information of the gene to which the polynucleotides correspond (e.g., a gene, or mRNA encoded by the gene, having a sequence of the polynucleotide described herein). This expanded sequence information can in turn be used to further characterize the corresponding gene, which in turn provides additional information about the nature of the gene product (e.g., the normal function of the gene product). The additional information can serve to provide additional evidence of the gene product's use as a therapeutic target, and provide further guidance as to the types of agents that can modulate its activity.

In one example, a contig is assembled using a sequence of a polynucleotide of the present invention, which is present in a clone. A "contig" is a contiguous sequence of nucleotides that is assembled from nucleic acid sequences having overlapping (e.g., shared or substantially similar) sequence information. The sequences of publicly-available ESTs (Expressed Sequence Tags) and the sequences of various clones from several cDNA libraries synthesized at Chiron can be used in the contig assembly.

The contig is assembled using the software program Sequencher, version 4.05, according to the manufacturer's instructions and an overview alignment of the contiged sequences is produced. The sequence information obtained in the contig assembly can then be used to obtain a consensus sequence derived from the contig using the Sequencher program. The consensus sequence is used as a query sequence in a TeraBLASTN search of the DGTI DoubleTwist Gene Index (DoubleTwist, Inc., Oakland, Calif.), which contains all the EST and non-redundant sequence in public databases.

Through contig assembly and the use of homology searching software programs, the sequence information provided herein can be readily extended to confirm, or confirm a predicted, gene having the sequence of the polynucleotides described in the present invention. Further the information obtained can be used to identify the function of the gene product of the gene corresponding to the polynucleotides described herein. While not necessary to the practice of the invention, identification of the function of the corresponding gene, can provide guidance in the design of therapeutics that target the gene to modulate its activity and modulate the cancerous phenotype (e.g., inhibit metastasis, proliferation, and the like).

Example 28

Expression of Chondroitin 4-O Sulfotransferase 2 (C4S-2)

Laser Capture Microdissection (LCM) was used to dissect cancerous cells, as well as peri-tumoral normal cells from patients with prostate cancer (various grades), colon cancer, breast cancer and stomach cancer. Total RNA was prepared from these samples by standard methods. cDNA probes were made from this RNA and fluorescently labeled. The labeled cDNAs were used to probe a microarray chip containing sequences of multiple genes. As shown in Table 16, Spot ID 25837, which corresponds to chondroitin 4-O sulfotransferase 2 (C4S-2) and SEQ ID 847 (see Table 15), revealed a differential expression between normal and cancerous cells. The data displayed in FIG. 22 show an up-regulation of C4S-2 mRNA in prostate, colon and stomach cancer. The table headings are as follows: "# Patients" indicates the number of patients whose RNA was analyzed for each cancer type, and the percentages of each of the patient groups is expressed in the table; ">2×" indicates a greater than two-fold up-regulation (cancer over normal) at the mRNA level; ">5×" indicates a greater than 5-fold up-regulation at the mRNA level; "<0.5×" indicates a greater than 2-fold down-regulation at the mRNA level. Further experimental details of this example may be found in Example 20 of this disclosure.

Figure 34:
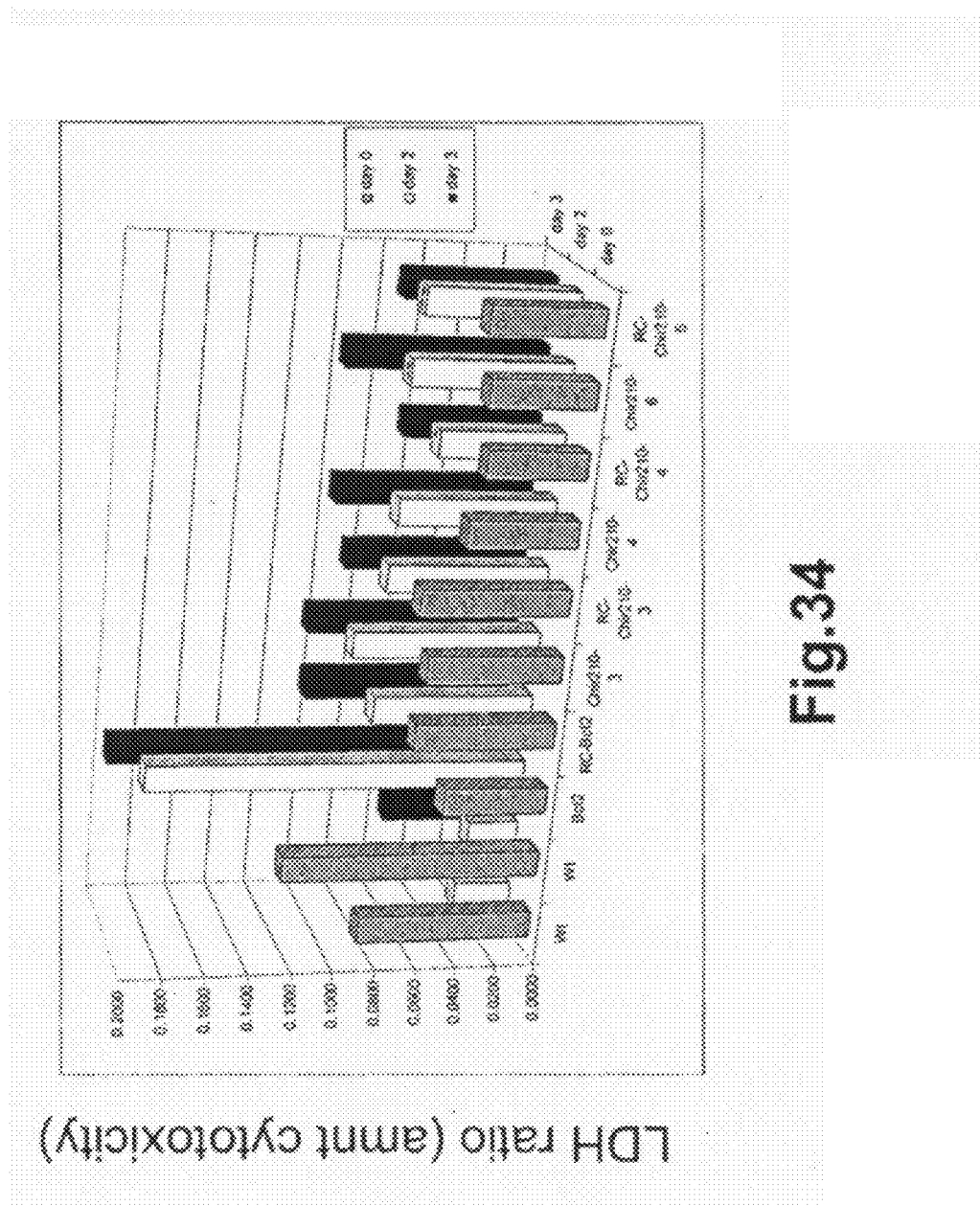
FIG. 34 is a three dimensional bar graph showing effects of C4S-2 antisense molecules on 184B5 cell cytotoxicity.

Trending analysis revealed that several genes trend in patient expression with C4S-2 (FIG. 34). These genes may have significance in pathways, both upstream and downstream of C4S-2.

Example 29

C4S-2 mRNA Expression in Laser Capture Microdissected Tissues

Quantitative PCR of a number of normal tissues and tumor cell lines, particularly colorectal and prostate carcinoma cell lines was used to analyze expression of C4S2. Quantitative real-time PCR was performed by first isolating RNA from cells using a Roche RNA Isolation kit according to manufacturer's directions. One microgram of RNA was used to synthesize a first-strand cDNA using MMLV reverse transcriptase (Ambion) using the manufacturers buffer and recommended concentrations of oligo dT, nucleotides, and Rnasin.

First, primers were designed. The primers were blasted against known genes and sequences to confirm the specificity of the primers to the target. The sequences of the primers are, for set 1: Forward: ATCTCCGCCTTCCGCAGCAA (SEQ ID NO: 14067) and reverse: TCGTTGAAGGGCGCCAGCTT (SEQ ID NO: 14068), and set 2: forward: CATCTACTGCTACGTG (SEQ ID NO: 14069) and reverse: ACTTCTTGAGCTTGACC (SEQ ID NO: 14070). These primers were used in a test qPCR using the primers against normal RTd tissue, as well as a mock RT to pick up levels of possible genomic contamination.

Quantitative PCR of a panel of normal tissue, total cancer tissue, LCM tissue, and cancer cell lines were used to determine the expression levels of C4S2. qPCR was performed by first isolating the RNA from the above mentioned tissue/cells using a Qiagen RNeasy mini prep kit. In the case of the LCM tissue, RNA was amplified via PCR to increase concentration after initial RNA isolation. 0.5 micrograms of RNA was used to generate a first strand cDNA using Stratagene MuLV Reverse Transcriptase, using recommended concentrations of buffer, enzyme, and Rnasin. Concentrations and volumes of dNTP, and oligo dT, or random hexamers were lower than recommended to reduce the level of background primer dimerization in the qPCR.

The cDNA is then used for qPCR to determine the levels of expression of C4S2 using the GeneAmp 7000 by ABI as recommended by the manufacturer. Primers for housekeeping were also run in order to normalized the values, and eliminate possible variations in cDNA template concentrations, pipetting error, etc. Three housekeepers were run depending on the type of tissue, beta-actin for cell lines, GusB for LCM tissue, HPRT for whole tissue.

Figure 23:
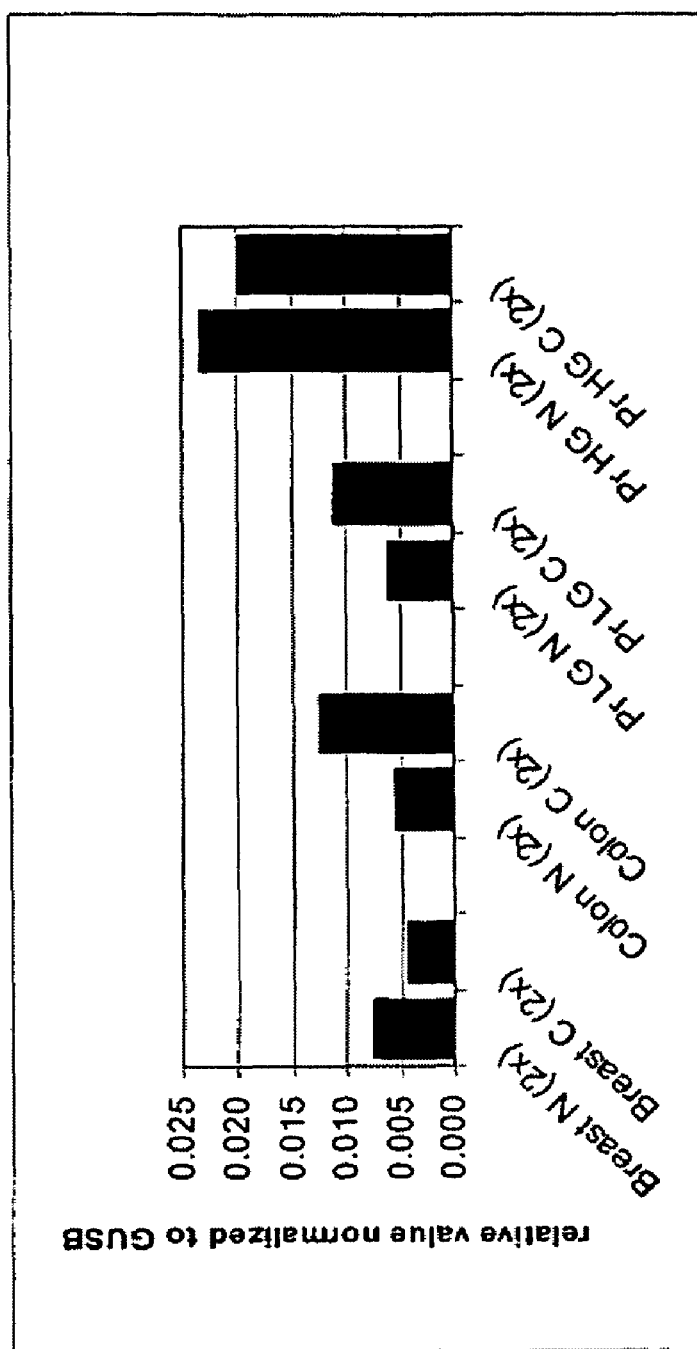
FIG. 23 is a bar graph showing C4S-2 mRNA expression in laser capture microdissected tissues, as determined by quantitative PCR analysis.

A subset of patient RNA used to probe the microarray chip was analyzed by semi-quantitative RT-PCR to confirm the microarray results. Pools of 7 or 8 patient RNA samples were analyzed using primers that specifically recognize C4S-2. The data is expressed as mRNA expression level relative to a housekeeping gene (GUSB). Consistent with the microarray data, the data, displayed in FIG. 23, show an up-regulation of C4S-2 mRNA in prostate and colon cancer and a down-regulation in breast cancer. Furthermore, the data reveal that peri-tumoral normal cells in high grade prostate cancer display an elevated expression relative to peri-tumoral normal cells in low grade prostate cancer, suggesting a global up-regulation of C4S-2 mRNA with progression in grade. "(2×)" indicates RNA was amplified two times; "N" indicates peritumoral normal epithelial cells; "C" indicates cancerous epithelial cells; "LG" indicates low grade; "HG" indicates high grade.

Example 30

C4S-2 mRNA Expression in Tissue Samples

Figure 24:
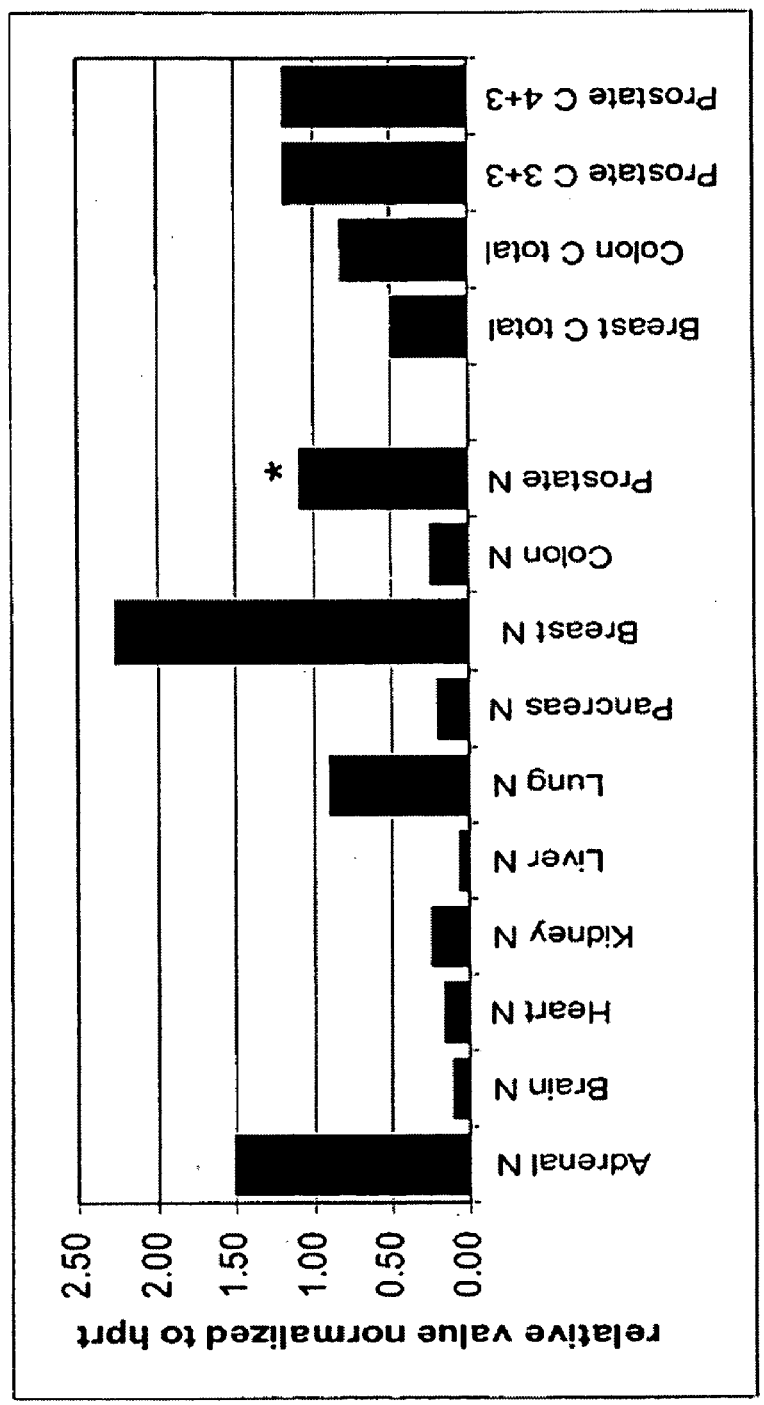
FIG. 24 is a bar graph showing C4S-2 mRNA expression in tissue samples.

Using the RT-PCR methods described above, C4S-2 specific primers were used to assess the expression of C4S-2 mRNA obtained from normal tissues (from commercial sources), as well as RNA expression whole tumor tissue (pools of 7 or 8 patients). This tissue contains cell types other than epithelium. The data is expressed as mRNA expression level relative to a housekeeping gene (HPRT). The data, shown in FIG. 24, reveal that C4S-2 mRNA is ubiquitously expressed, throughout the body, with highest expression in normal adrenal, lung and breast tissue. The data further reveal significant expression in colon and prostate cancer (marked with a "C") and down-regulation in breast cancer, relative to normal breast tissue.

Example 31

C4S-2 mRNA Expression in Prostate Cell Lines

Figure 25:
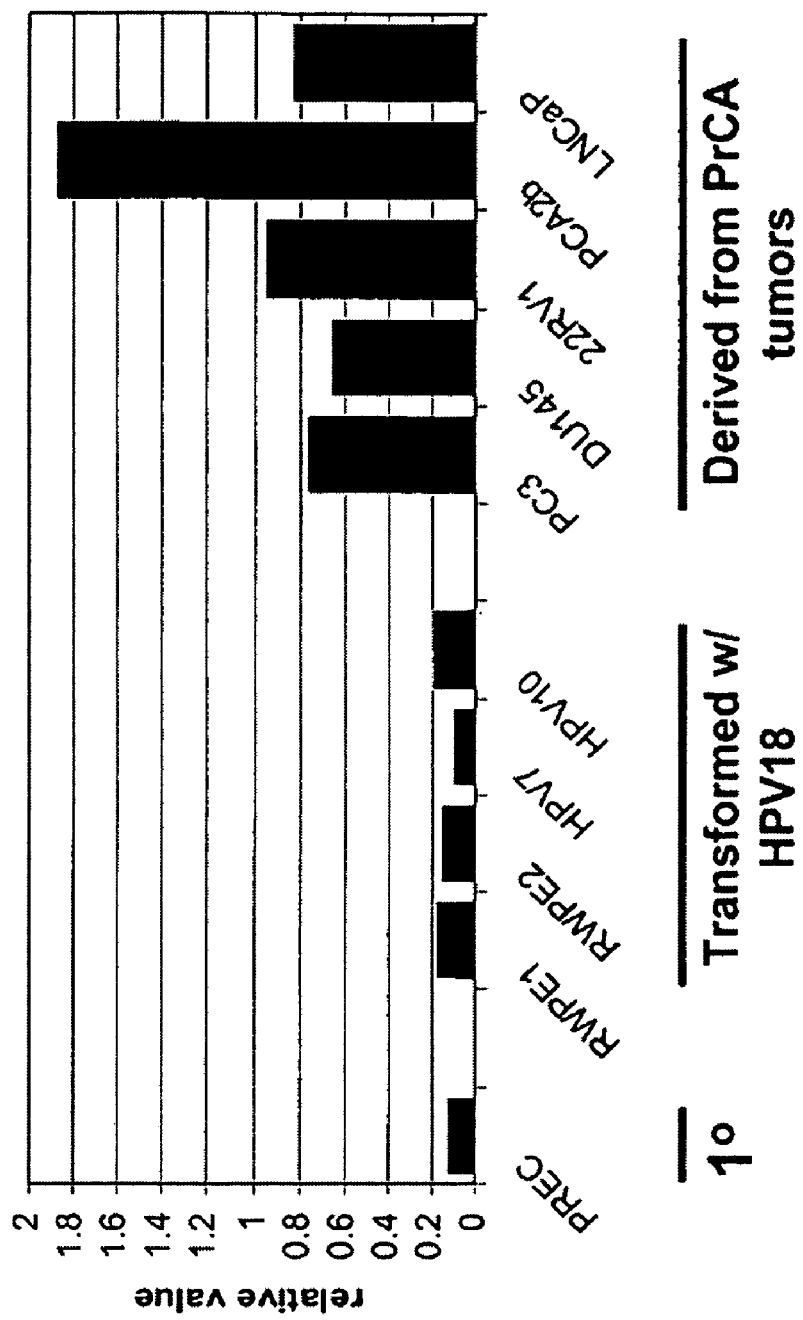
FIG. 25 is a bar graph showing C4S-2 mRNA expression in prostate cell lines.

Using the RT-PCR methods described above, C4S-2 specific primers were used to assess the expression of C4S-2 mRNA obtained from various prostate cell lines. The data is expressed as mRNA expression level relative to a housekeeping gene (actin). The data, displayed in FIG. 25, show that C4S-2 mRNA is expressed at higher levels in cell lines derived from prostate cancer tumors than in cell lines derived from normal prostate epithelium.

Example 32

Antisense Regulation of C4S-2 Expression

Additional functional information on C4S-2 was generated using antisense knockout technology. A number of different oligonucleotides complementary to C4S-2 mRNA were designed (FIG. 26) as potential antisense oligonucleotides, and tested for their ability to suppress expression of C4S-2. For each transfection mixture, a carrier molecule, preferably a lipitoid or cholesteroid, was prepared to a working concentration of 0.5 mM in water, sonicated to yield a uniform solution, and filtered through a 0.45 µm PVDF membrane. The antisense or control oligonucleotide was then prepared to a working concentration of 100 µM in sterile Millipore water. The oligonucleotide was further diluted in OptiMEM™ (Gibco/BRL), in a microfuge tube, to 2 µM, or approximately 20 µg oligo/ml of OptiMEM™. In a separate microfuge tube, lipitoid or cholesteroid, typically in the amount of about 1.5-2 nmol lipitoid/µg antisense oligonucleotide, was diluted into the same volume of OptiMEM™ used to dilute the oligonucleotide. The diluted antisense oligonucleotide was immediately added to the diluted lipitoid and mixed by pipetting up and down. Oligonucleotide was added to the cells to a final concentration of 30 nM.

The level of target mRNA (C4S-2) in the transfected cells was quantitated in the cancer cell lines using the methods described above. Values for the target mRNA were normalized versus an internal control (e.g., beta-actin). For each 20 µl reaction, extracted RNA (generally 0.2-1 µg total) was placed into a sterile 0.5 or 1.5 ml microcentrifuge tube, and water was added to a total volume of 12.5 µl. To each tube was added 7.5 µl of a buffer/enzyme mixture, prepared by mixing (in the order listed) 2.5 µl $H_2O$, 2.0 µl 10× reaction buffer, 10 µl oligo dT (20 pmol), 1.0 µl dNTP mix (10 mM each), 0.5 µl RNAsin® (20 u) (Ambion, Inc., Hialeah, Fla.), and 0.5 µl MMLV reverse transcriptase (50 u) (Ambion, Inc.). The contents were mixed by pipetting up and down, and the reaction mixture was incubated at 42° C. for 1 hour. The contents of each tube were centrifuged prior to amplification.

An amplification mixture was prepared by mixing in the following order: 1× PCR buffer II, 3 mM $MgCl_2$, 140 µM each dNTP, 0.175 pmol each oligo, 1:50,000 dil of SYBR® Green, 0.25 mg/ml BSA, 1 unit Taq polymerase, and $H_2O$ to 20 µl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 µl aliquot of amplification mixture, 2 µl of template RT was added, and amplification was carried out according to standard protocols.

FIG. 26 shows examples of anti-sense oligonucleotide sequences that inhibit C4S-2 mRNA expression when transfected into cells. Functional data described in the following examples was obtained using C210-3,4 & 6. C4S-2 mRNA reduction ranged from about 60 to about 90%, as compared to cells transfected with reverse (i.e. sense) control oligonucleotides.

In separate experiments, inhibitory RNA molecules are used to inhibit C4S-2 mRNA expression in cells. FIG. 27 lists inhibitory RNA oligonucleotides that may be used in these experiments.

Example 33

Effects of C4S-2 Antisense Molecules on Cellular Proliferation

PC3 cells were plated at 5000 cells/well in 96-well plate and grown overnight. Reverse control or antisense oligonucleotide was diluted to 2 µM in OptiMEM™ and mixed with 30 µM Lipitoid1, a delivery vehicle, also diluted in OptiMEM™. This mixture of oligonucleotide and lipitoid in OptiMEM™ was then mixed with serum containing medium and then overlayed onto the cells overnight. The next day the transfection mix was removed and replaced with fresh media. Final concentration of oligonucleotide for these experiments was 300 nM and the ratio of oligonucleotide to Lipitoid 1 was 1.5 nmol lipoid per µg oligonucleotide. Cell proliferation was quantified using CyQUANT® Cell Proliferation Assay Kit (Molecular Probes #C-7026).

MDAPca2b cells were plated to 50% confluency and similarly transfected with 300 nM reverse control or antisense oligonucleotide with 30 µM Lipitoid1 overnight. After transfection, the cells were detached with trypsin, washed twice with medium, counted and plated at 5000 cells/well in 96-well plates. Cell proliferation was quantified using Cell-Titer-Glo™ Luminescent Cell Viability Assay (Promega #G7573).

Figure 28:
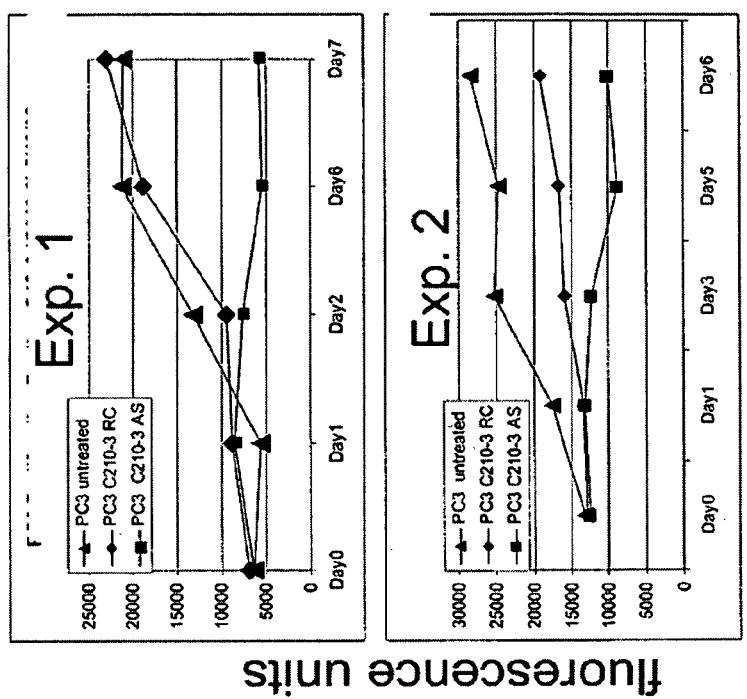
FIG. 28 is two line graphs showing the effect of C4S-2 antisense molecules on growth of PC3 cells.

Using these methods, anti-sense oligonucleotides described in FIG. 26 were transfected into PC3 cells. This usually resulted in a 60-90% knockdown of C4S-2 mRNA compared to controls. As controls, cells were left either untreated or were transfected with reverse control oligonucleotides. The cells were assessed for their ability to grow on tissue culture plastic in a time course that spanned 7 days. The number of cells on any given day was assessed using either the CyQuant assay or the luciferase assay. As shown in the two repeats of the same experiment described in FIG. 28, the ability of PC3 cells to grow in vitro is inhibited by anti-sense oligonucleotides that inhibit C4S-2 expression.

Figure 29:
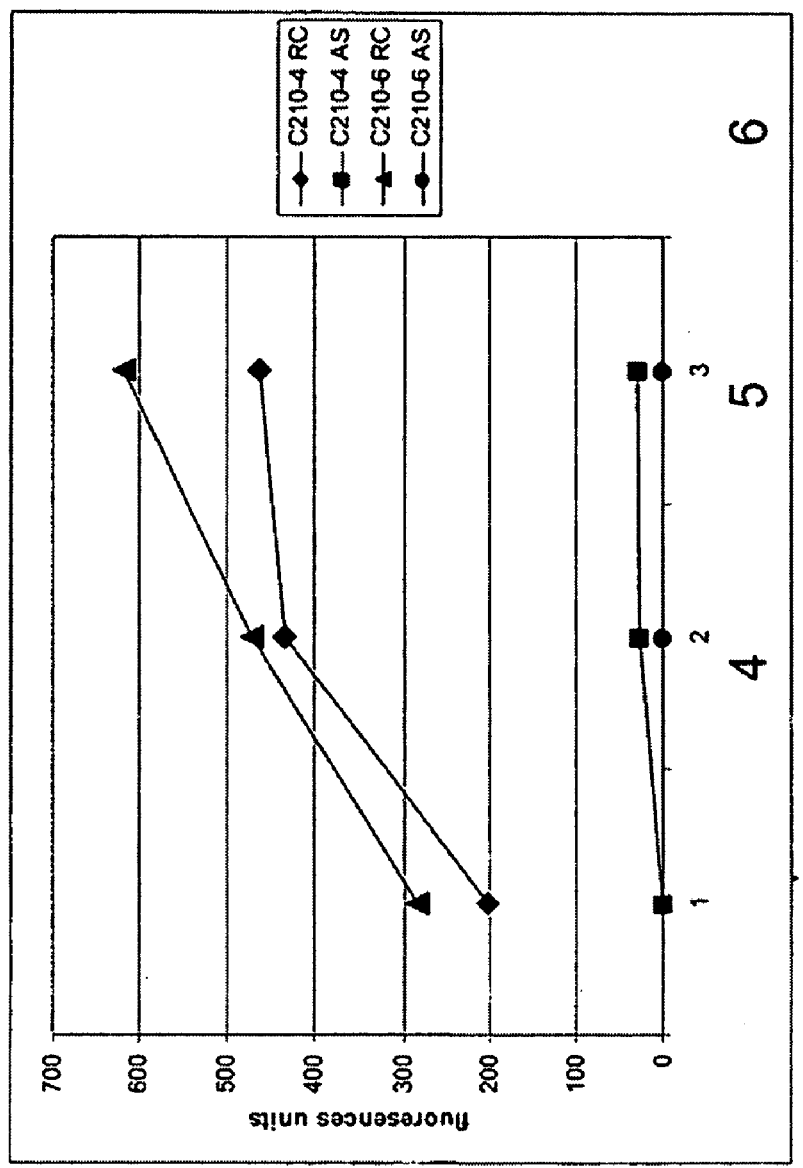
FIG. 29 is a line graph showing the effect of C4S-2 antisense molecules on growth of MDA PCa 2b cells.

Anti-sense oligonucleotides described in FIG. 26 were transfected into MDA Pca 2b cells. This resulted in a 60-90% knockdown of C4S-2 mRNA. As controls, cells were left either untreated or were transfected with reverse control oligonucleotides. The cells were assessed for their ability to grow on tissue culture plastic in a time course that spanned 7 days. The number of cells on any given day was assessed using either the CyQuant assay or the luciferase assay (depending on the experiment). As shown in FIG. 29, the ability of MDA Pca 2b cells to grow in vitro is inhibited by anti-sense oligonucleotides that inhibit C4S-2 expression ("RC" is a control oligonucleotide; measurements 1, 2 and 3 were taken on three days).

Example 34

Effects of C4S-2 Antisense Molecules on Colony Formations

The effect of C4S-2 expression upon colony formation was tested in a soft agar assay. Soft agar assays were conducted by first establishing a bottom layer of 2 ml of 0.6% agar in media plated fresh within a few hours of layering on the cells. The cell layer was formed on the bottom layer by removing cells transfected as described above from plates using 0.05% trypsin and washing twice in media. The cells were counted in a Coulter counter, and resuspended to $10^6$ per ml in media. 10 µl aliquots are placed with media in 96-well plates (to check counting with WST1), or diluted further for soft agar assay. 2000 cells are plated in 800 µl 0.4% agar in duplicate wells above 0.6% agar bottom layer. After the cell layer agar solidifies, 2 ml of media is dribbled on top and antisense or reverse control oligo is added-without delivery vehicles. Fresh media and oligos are added every 3-4 days. Colonies are formed in 10 days to 3 weeks. Fields of colonies were counted by eye.

Figure 30:
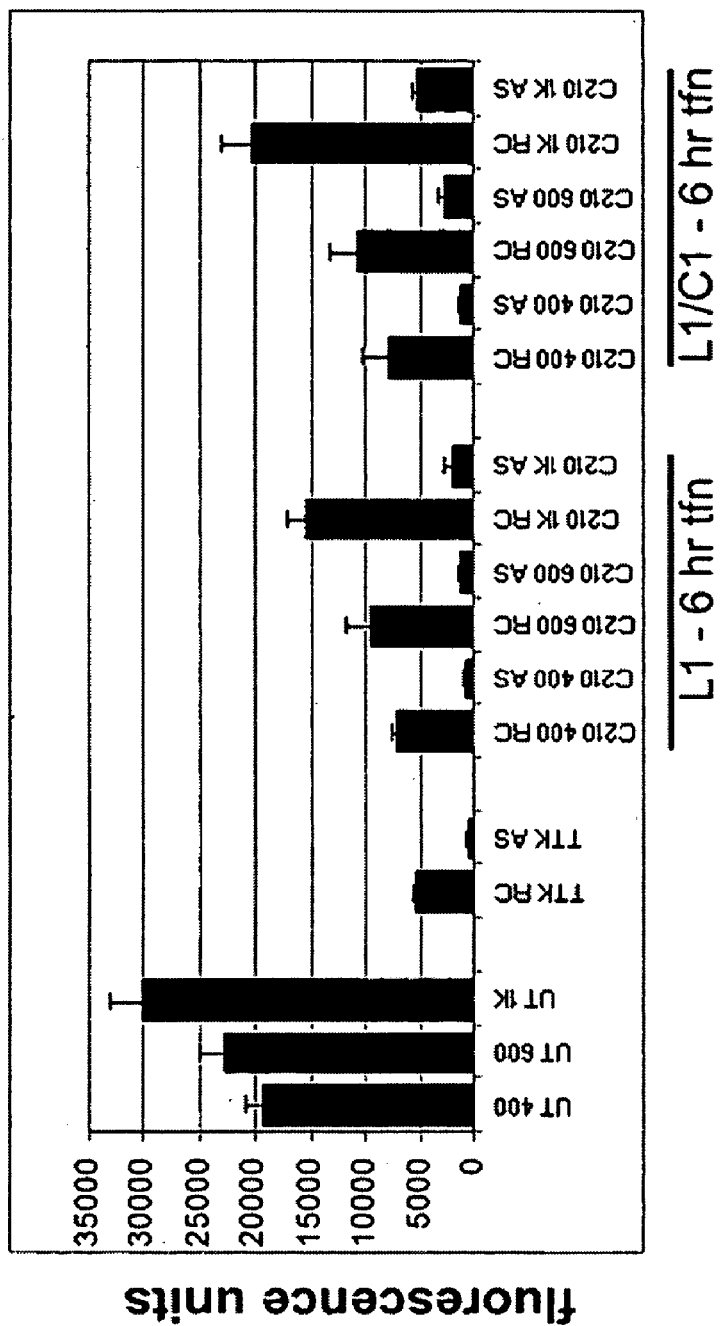
FIG. 30 is a bar graph showing the effects of C4S-2 antisense molecules on PC3 growth in soft-agar.
Figure 31:
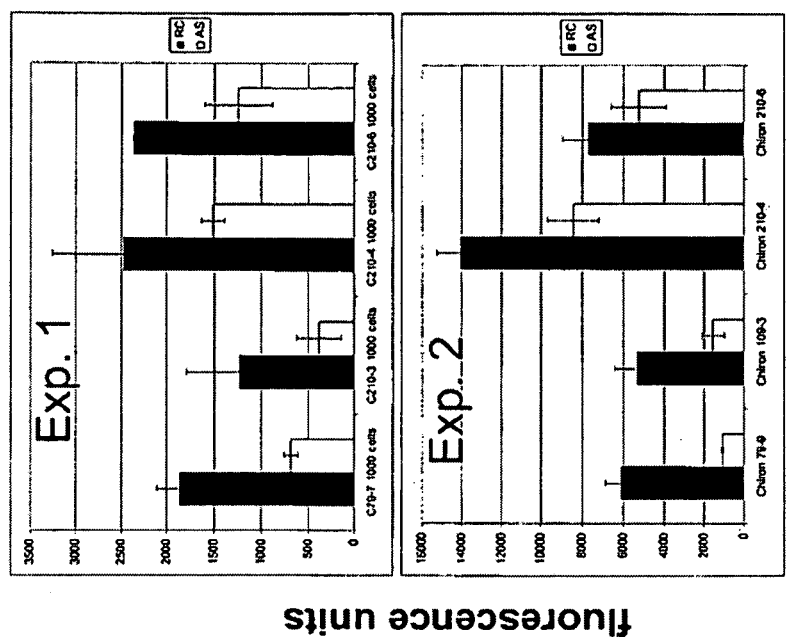
FIG. 31 is two line graphs showing the effects of C4S-2 antisense molecules on growth of MDA PCa 2b cells growth in soft-agar.

PC3 cells were transfected as described above. Transfected cells were then assessed for their ability to grow in soft-agar to determine the effect of inhibiting C4S-2 on anchorage-independent growth. PC3 cells were plated at either 400, 600 or 1000 ("1 k") cells per well. Multiple transfection conditions were used (L1 or L1/C1). As shown in FIG. 30, PC3 cells transfected with C4S-2 anti-sense oligos consistently yielded fewer colonies than those transfected with reverse control oligos. "UT" denotes untransfected cells; "RC" denotes transfected with reverse control oligos; "AS" denotes transfected with anti-sense oligos;

MDA Pca 2b cells were transfected as described above and also assessed for their ability to grow in soft-agar to determine the effect of inhibiting C4S-2 on anchorage-independent growth. MDA Pca 2b cells were plated at either 400, 600 or 1000 cells per well. As shown in FIG. 31, MDA Pca 2b cells transfected with C4S-2 anti-sense oligos consistently yielded fewer colonies than those transfected with reverse control oligos.

Example 34

Effects of C4S-2 Antisense Molecules on Spheroids

Spheroids were assayed as follows: briefly, 96-well plates were coated with poly(2-hydroxyethyl methacrylate or poly-HEMA at 12 ug/ml in 95% ethanol. Poly-HEMA was slowly evaporated at room temperature until plates were dry. Prior to adding cells plates were rinsed twice with 1×PBS. Approximately 10 000 cells/well were then added and transfected with either anti-sense or reverse control oligonucleotide, directly in suspension with similar conditions as described elsewhere. The cells were allowed to grow in suspension for 5 days. The effects of inhibiting C4S-2 mRNA expression were assessed both visually and using the LDH assay to assess degree of cytotoxicity.

Lactate dehydrogenase (LDH) activity is measured, using the Cytotoxicity Detection Kit (Roche Catalog number: 1 644 793) by collecting culture supernatant and adding 100 ul ALPHA MEM medium w/o FBS in V-bottom 96 well plate, transferring all the culture supernatant (100 ul) to the V-bottom plate, mixing, spinning the plate at 2000 rpm for 10 mins, and removing 100 µl for an LDH assay. Alternatively, culture supernatant was removed, and 200 ul ALPHA MEM medium w/o FBS and containing 2% Triton-X 100 was added to the plate, incubated for 1 minute to all for lysis, spun at 2000 rpm for 10 min and 100 µl removed for LDH detection.

LDH was measured using a 1:45 mixture of catalyst, diaphoreses/$NAD^+$ mixture, lyophilizate resuspended $H_2O$ and dye solution containing sodium lactate, respectively. 100 ul of this mix is added to each well, and the sample incubated at room temperature for 20 mins. Plates can be reat in a microtiter plate reader with 490 nm filter.

rLDH/tLDH ratio is calculated as follows: the total amount of LDH (tLDH) is calculated by adding released LDH (rLDH, from culture supernatant) to the intracellular LDH (iLDH, from cell lysate): tLDH=rLDH+iLDH. In order to compare the amount of cytotoxicity between AS and RC treated samples, the ratio between rLDH and tLDH is used.

MDA Pca 2b were plated under non-adherent conditions and transfected in suspension with either anti-sense or reverse control oligonucleotides. The cells were allowed to grow in suspension for 5 days. The effects of inhibiting C4S-2 mRNA expression were assessed both visually (FIG. 32A-C) and using the LDH assay to assess degree of cytotoxicity (FIG. 32D). Inhibiting C4S-2 mRNA expression inhibited the ability of MDA Pca 2b to grow in suspension and furthermore, induced cytotoxicity.

Example 35

Effects of C4S-2 Antisense Molecules on Cytoxicity

Figures 33A, 33B, 33C:
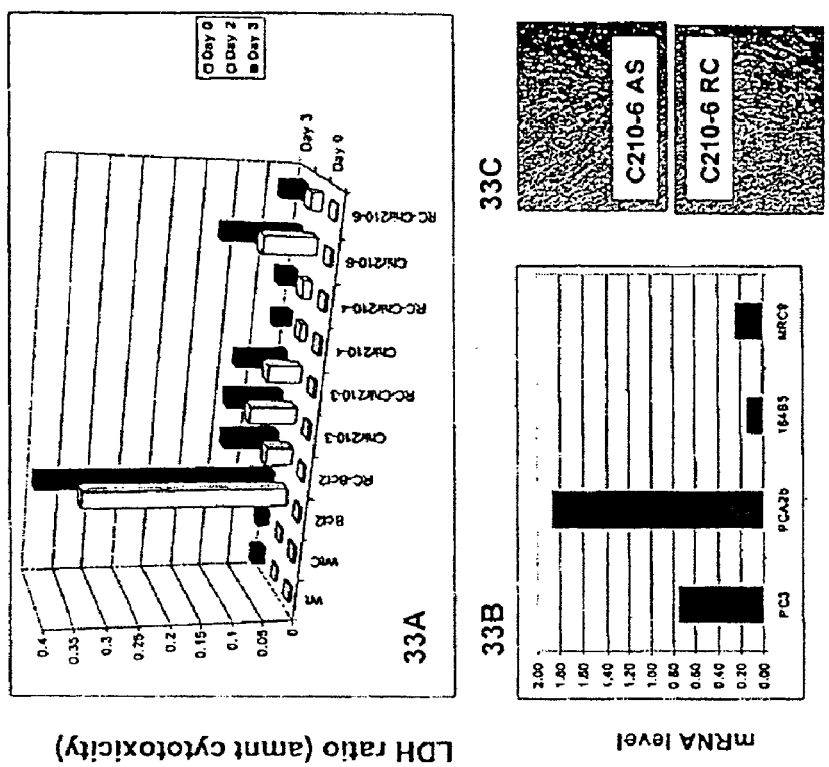
FIG. 33A-C show the effects of C4S-2 antisense molecules on MRC9 cells.

Cells were transfected, and the activity of LDH was measured using the Cytotoxicity Detection Kit from Roche Molecular Biochemicals, as described above. The data is provided as a ratio of LDH released in the medium vs. the total LDH present in the well at the same time point and treatment (rLDH/tLDH). MRC9 cells were transfected with multiple pairs of C4S-2 anti-sense and reverse control oligonucleotides and allowed to grow for 3 days. The C4S-2 anti-sense oligonucleotides did not induce cytotoxicity (above reverse control) in this "normal" (i.e. non-cancerous) fibroblast cell line (FIG. 33A). Controls antisense molecules, such as those for Bcl2, induced cytotoxicity. mRNA levels were also measured (FIG. 33B), showing that C4S-2 mRNA expression is lower in these cells than in other cells, and that no morphological differences in the antisensed cells as compared to control cells were observed (FIG. 33C).

184B5 cells were also transfected with multiple pairs of C4S-2 anti-sense and reverse control oligonucleotides and allowed to grow for 3 days. The C4S-2 anti-sense oligonucleotides did not induce cytoxicity (above reverse control) in this "normal" (i.e. non-cancerous) breast epithelial cell line (FIG. 34).

Example 36

Effects of C4S-2 Antisense Molecules on Proliferation of Normal Cells

Figure 35:
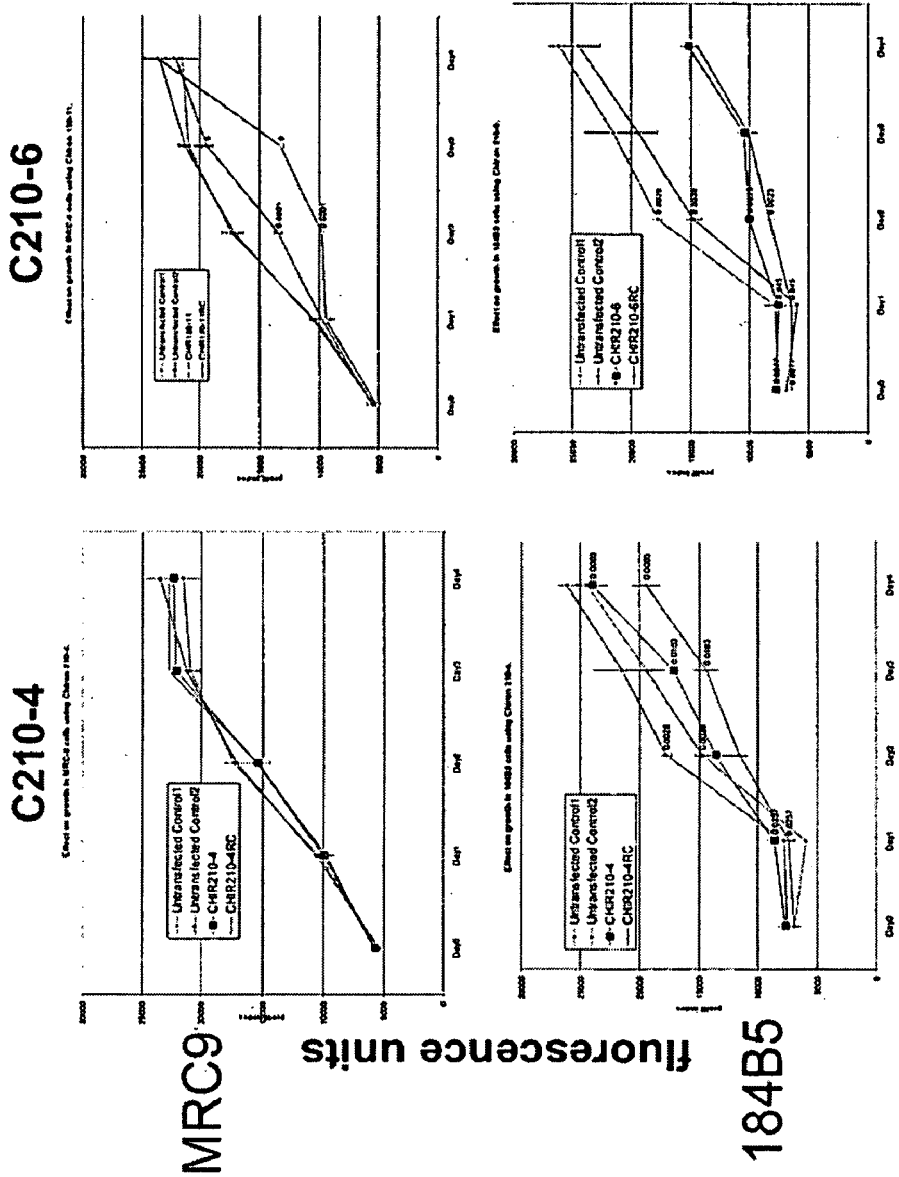
FIG. 35 is a composite of graphs showing effects of C4S-2 antisense molecules on 184B5 and MRC9 cell proliferation.

MRC9 and 184B5 cells were transfected with multiple pairs of C4S-2 anti-sense and reverse control oligonucleotides and allowed to grow for 4 days. The C4S-2 anti-sense oligonucleotides did not inhibit proliferation (above reverse control) in these non-cancerous cell lines (FIG. 35).

Example 37

Screening Assays

Screening assays are performed according to Burkart & Wong *Anal Biochem* 274:131-137 (1999), with modifications.

Using primers flanking the open reading frame, C4S-2 is cloned into a shuttle vector, from which it can be shuttled into multiple expression vectors. Protein expression is assessed using a polyclonal antibody. Activity is assessed using standard assays, i.e. those designed to assay sulfate transfer to chondroitin, chondroitin sulfate or dermatan sulfate. βAST-IV is also cloned and expressed as described in the above report Burkart et al, supra.

C4S-2-modulatory agents are counter-screened to ensure specificity. Included in the counterscreen are C4S-1, C4S-3 and HNK1ST (closest relatives to C4S-2 with approximately 30-42% homology). Additionally, representatives from other classes of sulfotransferases (heparin sulfotransferase, estrogen sulfotransferase, phenol sulfotransferase, tyrosine sulfotransferase) with low homology are also screened. Additionally, representatives from classes of kinases will be used in the counter-screen.

C4S-2 will transfer a sulfonyl group from PAPS to chondroitin sulfate, thus generating PAP. βAST-IV will regenerate PAPS, using p-nitrophenyl sulfate as the sulfate donor. One of the resulting products from the latter reaction—p-nitrophenol can be monitored colorimetrically.

Inhibitors are assessed for their ability to inhibit C4S-2, as determined by an inhibition of p-nitrophenol generation. Control screens include regeneration of PAPS from PAP by βAST-IV, in the absence of C4S-2, to ensure that inhibitors of βAST-IV are not selected. Compounds that inhibit C4S-2 activity are counterscreened against relevant enzymes listed above.

Inhibitors passing the above screens are tested in cell-based functional assays (Proliferation, LDH, spheroid and soft-agar assays). The tested cell lines include PC3, MDA Pca 2b, DU145, Colo320, KM12C, A431, MDA435, MDA469, etc. Additionally, cell lines stably transfected to over-express C4S-2 are assessed compared to parental and control transfected lines.

Inhibitors that show efficacy in the cell line functional assays are tested in xenograft mouse models. A subset of the lines, including PC3, DU145 and MDA435, etc. is in these animal models.

Example 38

Source of Biological Materials

The cells used for detecting differential expression of breast cancer related genes were those previously described for the HMT-3522 tumor reversion model, disclosed in U.S. Pat. Nos. 5,846,536 and 6,123,941, herein incorporated by reference. The model utilizes both non-tumorigenic (HMT-3522 S1) and tumorigenic (HMT-3522 T4-2) cells derived by serial passaging from a single reduction mammoplasty. In two dimensional (2D) monolayers on plastic, both S1 and T4-2 cells display similar morphology. But in three dimensional (3D) matrigel cultures, S1 form phenotypically normal mammary tissue structures while T4-2 cells fail to organize into these structures and instead disseminate into the matrix. This assay was designated as a tumor reversion model, in that the T4-2 cells can be induced to form S1-like structures in 3D by treatment with beta-1 integrin or EGFR blocking antibodies, or by treating with a chemical inhibitor of the EGFR signaling pathway (tyrophostin AG 1478). These treated T4-2 cells, called T4R cells, are non-tumorigenic.

Example 39

Cell Growth and RNA Isolation

Growth of Cells 2D and 3D for Microarray Experiments: HMT3522 S1 and T4-2 cells were grown 2D and 3D and T4-2 cells reverted with anti-EGFR, anti-beta 1 integrin, or tyrophostin AG 1478 as previously described (Weaver et al J Cell Biol. 137:231-45, 1997; and Wang et al PNAS 95:14821-14826, 1998). Anti-EGFR (mAb 225) was purchased from Oncogene and introduced into the matrigel at the time of gelation at a concentration of 4 ug/ml purified mouse IgG1. Anti-beta 1 integrin (mAb AIIB2) was a gift from C. Damsky at the University of California at San Francisco and was also introduced into the matrigel at the time of gelation at a concentration of 100 ug/ml ascites protein (which corresponds to 4-10 ug/ml purified rat IgG1). Tyrophostin AG 1478 was purchased from Calbiochem and used at a concentration of 100 nM.

Isolation of RNA for Microarray Experiments: RNA was prepared from: S1 passage 60 2D cultures; T4-2 passage 41 2D cultures; S1 passage 59 3D cultures; and T4-2 and T4-2 revertant (with anti-EGFR, anti-beta 1 integrin, and tyrophostin) passage 35 3D cultures.

All RNA for microarray experiments was isolated using the commercially available RNeasy Mini Kit from Qiagen. Isolation of total RNA from cells grown 2D was performed as instructed in the kit handbook. Briefly, media was aspirated from the cells and kit Buffer RLT was added directly to the flask. The cell lysate was collected with a rubber cell scraper, and the lysate passed 5 times through a 20-G needle fitted to a syringe. One volume of 70% ethanol was added to the homogenized lysate and mixed well by pipetting. Up to 700 ul of sample was applied to an RNeasy mini spin column sitting in a 2-ml collection tube and centrifuged for 15 seconds at >8000×g. 700 ul Buffer RW1 was added to the column and centrifuged for 15 seconds at >8000×g to wash. The column was transferred to a new collection tube. 500 ul Buffer RPE was added to the column and centrifuged for 15 seconds at >8000×g to wash. Another 500 ul Buffer RPE was added to the column for additional washing, and the column centrifuged for 2 minutes at maximum speed to dry. The column was transferred to a new collection tube and RNA eluted from the column with 30 ul RNase-free water by centrifuging for 1 minute at >8000×g.

Isolation of total RNA from cells grown 3D was performed as described above, except cells were isolated from matrigel prior to RNA isolation. The cells were isolated as colonies from matrigel using ice-cold PBS/EDTA (0.01 M sodium phosphate pH 7.2 containing 138 mM sodium chloride and 5 mM EDTA). See Weaver et al, J Cell Biol 137:231-245, 1997; and Wang et al. PNAS 95:14821-14826, 1998.

Example 40

Detection and Identification of Genes Exhibiting Differential Expression

The relative expression levels of a selected sequence (which in turn is representative of a single transcript) were examined in the tumorigenic versus non-tumorigenic cell lines described above, following culturing of the cells (S1, T4-2 and T4R) in either two-dimensional (2D) monolayers or three-dimensional (3D) matrigel cultures as described above. Differential expression for a selected sequence was assessed by hybridizing mRNA from S1 and T4-2 2D cultures, and S1, T4-2 and T4R 3D cultures to microarray chips as described below, as follows: Exp1=T4-2 2D/S1 2D; Exp2=T4-2 3D/S1 3D; Exp3=S1 3D/S1 2D; Exp4=T4-2 3 D/T4-2 2D; Exp5=T4-2 3D/T4R (anti-EGFR) 3D; Exp6=T4-2 3D/T4R (anti-beta 1 integrin) 3D; and Exp7=T4-2 3D/T4R (tyrophostin AG 1478) 3D.

Each array used had an identical spatial layout and control spot set. Each microarray was divided into two areas, each area having an array with, on each half, twelve groupings of 32×12 spots for a total of about 9,216 spots on each array. The two areas are spotted identically which provide for at least two duplicates of each clone per array. Spotting was accomplished using PCR amplified products from 0.5 kb to 2.0 kb and spotted using a Molecular Dynamics Gen III spotter according to the manufacturer's recommendations. The first row of each of the 24 regions on the array had about 32 control spots, including 4 negative control spots and 8 test polynucleotides.

The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about 4 duplicate measurements for each clone, two of one color and two of the other, for each sample.

Identification Of Differentially Expressed Genes: "Differentially expressed" in the context of the present example meant that there was a difference in expression of a particular gene between tumorigenic vs. non-tumorigenic cells, or cells grown in three-dimensional culture vs. cells grown in two-dimensional culture. To identify differentially expressed genes, total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) Nature Med 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from tumorigenic RNA sample were compared to fluorescently labeled cDNAs prepared from non-tumorigenic cell RNA sample. For example, the cDNA probes from the non-tumorigenic cells were labeled with Cy3 fluorescent dye (green) and the cDNA probes prepared from the tumorigenic cells were labeled with Cy5 fluorescent dye (red).

The differential expression assay was performed by mixing equal amounts of probes from tumorigenic cells and non-tumorigenic cells, and/or cells grown in 3D vs. those grown in 2D. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS). After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to non-tumorigenic or tumorigenic cells grown two-dimensionally or three-dimensionally. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescence intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumorigenic and non-tumorigenic cells or cells grown two-dimensionally versus three-dimensionally. During initial analysis of the microarrays, the hypothesis was accepted if $p > 10^{-3}$, and the differential ratio was set to 1.000 for those spots. All other spots have a significant difference in expression between the two samples compared. For example, if the tumorigenic sample has detectable expression and the non-tumorigenic does not, the ratio is truncated at 1000 since the value for expression in the non-tumorigenic sample would be zero, and the ratio would not be a mathematically useful value (e.g., infinity). If the non-tumorigenic sample has detectable expression and the tumorigenic does not, the ratio is truncated to 0.001, since the value for expression in the tumor sample would be zero and the ratio would not be a mathematically useful value. These latter two situations are referred to herein as "on/off." Database tables were populated using a 95% confidence level (p>0.05).

In general, a polynucleotide is said to represent a significantly differentially expressed gene between two samples when there is detectable levels of expression in at least one sample and the ratio value is greater than at least about 1.2 fold, at least about 1.5 fold, or at least about 2 fold, where the ratio value is calculated using the method described above.

A differential expression ratio of 1 indicates that the expression level of the gene in tumorigenic cells was not statistically different from expression of that gene in the specific non-tumorigenic cells compared. A differential expression ratio significantly greater than 1 in tumorigenic breast cells relative to non-tumorigenic breast cells indicates that the gene is increased in expression in tumorigenic cells relative to non-tumorigenic cells, suggesting that the gene plays a role in the development of the tumorigenic phenotype, and may be involved in promoting metastasis of the cell. Detection of gene products from such genes can provide an indicator that the cell is cancerous, and may provide a therapeutic and/or diagnostic target. Likewise, a differential expression ratio significantly less than 1 in tumorigenic breast cells relative to non-tumorigenic breast cells indicates that, for example, the gene is involved in suppression of the tumorigenic phenotype. Increasing activity of the gene product encoded by such a gene, or replacing such activity, can provide the basis for chemotherapy. Such gene can also serve as markers of cancerous cells, e.g., the absence or decreased presence of the gene product in a breast cell relative to a non-tumorigenic breast cell indicates that the cell is cancerous.

Using the above methodology, three hundred and sixty-seven (367) genes or products thereof were identified from 20,000 chip clones analyzed as being overexpressed 2-fold or more in one or more of these experiments, with a p-value of 0.001 or less. These identified genes or products thereof are listed in Table 18, according to the Spot ID of the spotted polynucleotide, the Sample ID, the corresponding GenBank Accession Number (No.), the GenBank description (if available) for the corresponding Genbank Accession Number, and the GenBank score (p-value; the probability that the association between the SEQ ID NO. and the gene or product thereof occurred by chance). The polynucleotide and polypeptide sequences, as provided by any disclosed Genbank entries are herein incorporated by reference to the corresponding Genbank accession number. The differential hybridization results from the seven differential expression microarray experiments listed above are provided in Table 19, where sequences have a measurement corresponding to its ratio of expression in the 7 experiments, e.g. spot ID 10594 is 2.2-fold overexpressed in 3D T4-2 cells as compared to 3D S1 cells. SEQ ID NOS: 1-3004, representing the sequences corresponding to the spot Ids listed in Tables 18 and 19 are provided in the sequence listing. Table 20 is a lookup table showing the relationship between the spot Ids (i.e. the nucleic acids spotted on the microarray) and the sequences provided in the sequence listing.

TABLE 18

| SPOTID | SAMPLE ID | GENBANK NO | GENBANK DESCRIPTION | GENBANK SCORE |
|---|---|---|---|---|
| 10594 | I:1871362:05B01:A04 | M62994 | Homo sapiens thyroid autoantigen (truncated actin-binding protein) mRNA, complete cds | 8.6E−36 |
| 21851 | M00055153A:A12 | | | |
| 20990 | I:1986550:13B02:G12 | XM_005667 | Homo sapiens lipocalin 2 (oncogene 24p3) (LCN2), mRNA | 0 |
| 18641 | I:3473302:09A01:A09 | AB046098 | Macaca fascicularis brain cDNA, clone: QccE-15843 | 5.8E−57 |
| 17229 | I:1506962:09A01:G01 | AL365454 | Homo sapiens mRNA full length insert cDNA clone EUROIMAGE 926491 | 2.6E−110 |
| 25930 | 035JN020.F01 | AJ010446 | Homo sapiens mRNA for immunoglobulin kappa light chain, anti-RhD, therad 24 | 0 |
| 20701 | RG:730349:10010:G12 | U28387 | Human hexokinase II pseudogene, complete cds | 0 |
| 20346 | RG:1839794:10015:E11 | U28387 | Human hexokinase II pseudogene, complete cds | 0 |
| 21247 | M00054680C:A06 | U28387 | Human hexokinase II pseudogene, complete cds | 9.9E−80 |
| 23062 | M00056353C:E10 | XM_011013 | Homo sapiens filamin B, beta (actin-binding protein-278) (FLNB), mRNA | 0 |
| 25666 | 035Jn031.B01 | AF191633 | Homo sapiens filamin (FLNB) gene, exon 48 and complete cds | 0 |
| 19001 | I:2171401:09A02:E09 | AF123887 | Homo sapiens ERO1L (ERO1L) mRNA, partial cds | 3.3E−104 |
| 10897 | I:1852047:02A01:A10 | U22384 | Human lysyl oxidase gene, partial cds | 0 |
| 1960 | M00023297B:A10 | M33376 | Human pseudo-chlordecone reductase mRNA, complete cds | 0 |
| 26381 | 035JN029.H02 | AB037838 | Homo sapiens mRNA for KIAA1417 protein, partial cds | 0 |
| 26719 | 035JN030.A02 | X68277 | H. sapiens CL 100 mRNA for protein tyrosine phosphatase | 0 |

TABLE 18-continued

| SPOTID | SAMPLE ID | GENBANK NO | GENBANK DESCRIPTION | GENBANK SCORE |
|---|---|---|---|---|
| 27152 | 037XN007.A09 | XM_048479 | Homo sapiens hypothetical protein FLJ14642 (FLJ14642), mRNA | 7.3E−58 |
| 10926 | I:2047770:08B02:G04 | AK000969 | Homo sapiens cDNA FLJ10107 fis, clone HEMBA1002583 | 3.8E−94 |
| 28980 | 035JN003.C12 | XM_027456 | Homo sapiens hypothetical gene supported by AK000584 (LOC89942), mRNA | 0 |
| 1236 | M00022024A:F02 | | | |
| 29350 | 035JN008.D06 | XM_043864 | Homo sapiens phosphoinositide-3-kinase, regulatory subunit, polypeptide 1 (p85 alpha) (PIK3R1), mRNA | 0 |
| 26242 | 035JN015.B02 | AL137717 | Homo sapiens mRNA; cDNA DKFZp434J1630 (from clone DKFZp434J1630) | 2.6E−70 |
| 4098 | M00001439D:C09 | BC002446 | Homo sapiens, MRJ gene for a member of the DNAJ protein family, clone MGC: 1152 IMAGE: 3346070, mRNA, complete cds | 0 |
| 17432 | I:1965049:16B02:D07 | XM_051165 | Homo sapiens DKFZP586A0522 protein (DKFZP586A0522), mRNA | 0 |
| 1785 | SL198 | XM_051165 | Homo sapiens DKFZP586A0522 protein (DKFZP586A0522), mRNA | 0 |
| 28856 | 035JN032.E11 | X62996 | H. sapiens mitochondrial genome (consensus sequence) | 0 |
| 18791 | RG:229957:10007:D03 | D42042 | Human mRNA for KIAA0085 gene, partial cds | 0 |
| 22950 | M00056922C:C09 | | | |
| 1882 | M00022196B:D09 | Z29083 | H. sapiens 5T4 gene for 5T4 Oncofetal antigen | 0 |
| 23886 | M00055408A:F10 | | | |
| 24995 | M00055215C:E11 | XM_012880 | Homo sapiens hypothetical protein MGC1936 (MGC1936), mRNA | 0 |
| 24477 | M00055510B:F08 | AF240697 | Homo sapiens retinol dehydrogenase homolog isoform-2 (RDH) mRNA, complete cds | 0 |
| 21681 | M00056771C:A12 | X02152 | Human mRNA for lactate dehydrogenase-A (LDH-A, EC 1.1.1.27) | 0 |
| 9557 | I:1335140:05A02:C08 | X02152 | Human mRNA for lactate dehydrogenase-A (LDH-A, EC 1.1.1.27) | 0 |
| 22033 | M00056574B:A07 | | | |
| 873 | M00007979C:C05 | X00663 | Human mRNA fragment for epidermal growth factor (EGF) receptor | 0 |
| 17144 | RG:25254:10004:D07 | M97675 | Human transmembrane receptor (ror1) mRNA, complete cds | 0 |
| 26970 | 035JN015.F09 | AF097514 | Homo sapiens stearoyl-CoA desaturase (SCD) mRNA, complete cds | 0 |
| 21402 | M00054507C:D07 | | | |
| 27074 | 035Jn031.B03 | AF061741 | Homo sapiens retinal short-chain dehydrogenase/reductase retSDR1 mRNA, complete cds | 0 |
| 10963 | I:1258790:05A02:B10 | AF072752 | Homo sapiens ten integrin EGF-like repeat domains protein precursor (ITGBL1) mRNA, complete cds | 0 |
| 29525 | 035JN026.D12 | | | |
| 25514 | 035JN011.F01 | U62961 | Human succinyl CoA: 3-oxoacid CoA transferase precursor (OXCT) mRNA, complete cds | 0 |
| 26612 | 035JN016.C08 | NM_000240 | Homo sapiens monoamine oxidase A (MAOA), nuclear gene encoding mitochondrial protein, mRNA | 0 |
| 24600 | M00055490C:G11 | U57059 | Homo sapiens Apo-2 ligand mRNA, complete cds | 0 |
| 9741 | I:3126828:12A02:G02 | U37518 | Human TNF-related apoptosis inducing ligand TRAIL mRNA, complete cds | 0 |
| 23689 | M00054752A:E11 | XM_001468 | Homo sapiens S100 calcium-binding protein A10 (annexin II ligand, calpactin I, light polypeptide (p11)) (S100A10), mRNA | 0 |

TABLE 18-continued

| SPOTID | SAMPLE ID | GENBANK NO | GENBANK DESCRIPTION | GENBANK SCORE |
|---|---|---|---|---|
| 22352 | M00042842B:E02 | XM_001468 | Homo sapiens S100 calcium-binding protein A10 (annexin II ligand, calpactin I, light polypeptide (p11)) (S100A10), mRNA | 0 |
| 23806 | RG:2007319:20003:G10 | | | |
| 12285 | I:1404669:04A01:G12 | BC002517 | Homo sapiens, Pirin, clone MGC: 2083 IMAGE: 3140037, mRNA, complete cds | 0 |
| 27638 | 035JN011.D10 | AK002155 | Homo sapiens cDNA FLJ11293 fis, clone PLACE1009670, highly similar to Homo sapiens genethonin 1 mRNA | 0 |
| 9663 | I:2488567:11A02:H08 | XM_006027 | Homo sapiens brain-derived neurotrophic factor (BDNF), mRNA | 0 |
| 26850 | 035JN003.B03 | XM_031551 | Homo sapiens similar to carbohydrate (N-acetylglucosamine-6-O) sulfotransferase 2 (H. sapiens) (LOC90414), mRNA | 0 |
| 10204 | I:1491445:02B01:F09 | AF131765 | Homo sapiens clone 24833 nonsyndromic hearing impairment protein mRNA sequence, complete cds | 0 |
| 1318 | 2192-6 | | | |
| 25922 | 035JN020.B01 | AB020673 | Homo sapiens mRNA for KIAA0866 protein, complete cds | 0 |
| 26347 | 035JN025.G02 | | | |
| 20361 | I:395116:17A02:E05 | | | |
| 28672 | 035JN012.A05 | AF126181 | Homo sapiens breast cancer-associated gene 1 protein (BCG1) mRNA, complete cds | 0 |
| 25520 | 035JN011.A07 | D86956 | Human mRNA for KIAA0201 gene, complete cds | 0 |
| 1723 | M00005694A:A09 | BC001980 | Homo sapiens, clone IMAGE: 3462291, mRNA | 0 |
| 28863 | 037XN002.A05 | | | |
| 25526 | 035JN011.D07 | AF086281 | Homo sapiens full length insert cDNA clone ZD45G11 cDNA clone ZD45G11 | 0 |
| 27936 | 035JN008.A04 | X59445 | H. sapiens mRNA for colon carcinoma Manganese Superoxide Dismutase | 0 |
| 26851 | 035JN001.C03 | XM_033944 | Homo sapiens superoxide dismutase 2, mitochondrial (SOD2), mRNA | 0 |
| 25107 | M00054825A:E04 | AF075061 | Homo sapiens full length insert cDNA YP07G10 | 0 |
| 24912 | M00054505D:D06 | AF075061 | Homo sapiens full length insert cDNA YP07G10 | 0 |
| 25169 | M00055510D:D04 | M11167 | Human 28S ribosomal RNA gene | 1.2E−76 |
| 25600 | 035JN023.A01 | BC003107 | Homo sapiens, inhibitor of DNA binding 3, dominant negative helix-loop-helix protein, clone MGC: 1988 IMAGE: 3543936, mRNA, complete | 0 |
| 28706 | 035JN016.B05 | X55181 | Human ETS2 gene, 3'end | 0 |
| 26377 | 035JN029.F02 | Y14436 | Homo sapiens mRNA for phosphatidic acid phosphatase type 2 | 0 |
| 19460 | I:438655:14B02:B04 | AF007133 | Homo sapiens clone 23764 mRNA sequence | 4.5E−113 |
| 25243 | RG:1667183:10014:F12 | BC000013 | Homo sapiens, insulin-like growth factor binding protein 3, clone MGC: 2305 IMAGE: 3506666, mRNA, complete cds | 0 |
| 20018 | I:1213574:17B01:A11 | AB037925 | Homo sapiens MAIL mRNA, complete cds | 3.7E−106 |
| 918 | M00026895D:H03 | BC006433 | Homo sapiens, Ras-related GTP-binding protein, clone MGC: 13077 IMAGE: 3835186, mRNA, complete cds | 0 |
| 25027 | RG:1983823:20002:B06 | | | |
| 29089 | 035JN017.B06 | XM_037534 | Homo sapiens phosphodiesterase 7A (PDE7A), mRNA | 0 |
| 9141 | I:1347384:02A02:C07 | U78579 | Human type I phosphatidylinositol-4-phosphate 5-kinase beta (STM7) mRNA, partial cds | 0 |

TABLE 18-continued

| SPOTID | SAMPLE ID | GENBANK NO | GENBANK DESCRIPTION | GENBANK SCORE |
|---|---|---|---|---|
| 12005 | I:1259230:05A01:C06 | D87075 | Human mRNA for KIAA0238 gene, partial cds | 0 |
| 12148 | I:3360476:03B01:B12 | XM_040922 | *Homo sapiens* interleukin 13 receptor, alpha 2 (IL13RA2), mRNA | 0 |
| 17394 | RG:1943755:10016:A07 | AF346607 | *Homo sapiens* interleukin-1 receptor associated kinase 1b (IRAK) mRNA, complete cds, alternatively spliced | 0 |
| 27017 | 035JN021.F03 | XM_051742 | *Homo sapiens* spermine synthase (SMS), mRNA | 0 |
| 25809 | 035JN002.B07 | XM_009699 | *Homo sapiens* nuclear receptor interacting protein 1 (NRIP1), mRNA | 0 |
| 8719 | I:2600080:10A01:H01 | XM_009665 | *Homo sapiens* Kreisler (mouse) maf-related leucine zipper homolog (KRML), mRNA | 0 |
| 21030 | RG:1714832:10015:C06 | XM_029957 | *Homo sapiens* Rab acceptor 1 (prenylated) (RABAC1), mRNA | 0 |
| 11436 | I:1470085:03B01:F05 | XM_038976 | *Homo sapiens* N-ethylmaleimide-sensitive factor attachment protein, alpha (NAPA), mRNA | 0 |
| 10374 | I:1513989:03B02:C03 | XM_009010 | *Homo sapiens* complement component 3 (C3), mRNA | 1.4E−96 |
| 19037 | I:417827:15A01:G10 | X79538 | *H. sapiens* nuk_34 mRNA for translation initiation factor | 1.9E−28 |
| 398 | M00027016A:C05 | XM_031470 | *Homo sapiens* aldolase C, fructose-bisphosphate (ALDOC), mRNA | 4E−62 |
| 18773 | I:1211682:14A02:C09 | XM_008477 | *Homo sapiens* aldolase C, fructose-bisphosphate (ALDOC), mRNA | 0 |
| 3583 | M00023407B:C10 | | | |
| 3418 | M00001470A:C03 | XM_043951 | *Homo sapiens* CDP-diacylglycerol--inositol 3-phosphatidyltransferase (phosphatidylinositol syntase) (CDIPT), mRNA | 0 |
| 18985 | I:1402615:09A02:E03 | AF191148 | *Homo sapiens* type I transmembrane protein Fn14 mRNA, complete cds | 7.9E−64 |
| 25861 | 035JN010.D01 | XM_047975 | *Homo sapiens* hydroxyacyl glutathione hydrolase (HAGH), mRNA | 0 |
| 3317 | M00003974D:E04 | AF136185 | *Homo sapiens* collagen type XVII (COL17A1) gene; 3' UTR, long form | 0 |
| 8743 | I:1858905:04A01:D01 | U36775 | Human ribonuclease 4 gene, partial cds | 2.1E−57 |
| 26240 | 035JN015.A02 | XM_007493 | *Homo sapiens* ribonuclease, RNase A family, 4 (RNASE4), mRNA | 0 |
| 28562 | 037XN007.B11 | X00947 | Human alpha 1-antichymotrypsin gene fragment | 0 |
| 16877 | I:2362945:15A01:C07 | XM_029378 | *Homo sapiens* checkpoint suppressor 1 (CHES1), mRNA | 1.9E−91 |
| 25955 | 035JN022.C01 | AF035620 | *Homo sapiens* BRCA1-associated protein 2 (BRAP2) mRNA, complete cds | 0 |
| 26308 | 035JN023.C02 | XM_041470 | *Homo sapiens* zinc finger protein 145 (Kruppel-like, expressed in promyelocytic leukemia) (ZNF145), mRNA | 0 |
| 4140 | 2239-4 | X03083 | Human lactate dehydrogenase-A gene exon 7 and 3' flanking region | 0 |
| 3436 | 2239-1 | X03083 | Human lactate dehydrogenase-A gene exon 7 and 3' flanking region | 0 |
| 25612 | 035JN023.G01 | M94856 | Human fatty acid binding protein homologue (PA-FABP) mRNA, complete cds | 0 |
| 12257 | I:1448135:04A01:A06 | X15535 | *H. sapiens* lysosomal acid phosphatase gene (EC 3.1.3.2) Exon 11 | 0 |
| 9111 | I:1958902:04A02:D07 | D87258 | *Homo sapiens* mRNA for serin protease with IGF-binding motif, complete cds | 0 |

TABLE 18-continued

| SPOTID | SAMPLE ID | GENBANK NO | GENBANK DESCRIPTION | GENBANK SCORE |
|---|---|---|---|---|
| 17620 | I:875567:15B01:B08 | XM_045326 | *Homo sapiens* MAX-interacting protein 1 (MXI1), mRNA | 0 |
| 26025 | 035JN030.F01 | XM_032511 | *Homo sapiens* procollagen-proline, 2-oxoglutarate 4-dioxygenase (proline 4-hydroxylase), alpha polypeptide I (P4HA1), mRNA | 0 |
| 19271 | RG:686684:10010:D04 | AF005216 | *Homo sapiens* receptor-associated tyrosine kinase (JAK2) mRNA, complete cds | 0 |
| 4151 | 2035-1 | D87953 | Human mRNA for RTP, complete cds | 0 |
| 26569 | 035JN010.F02 | AB004788 | *Homo sapiens* mRNA for BNIP3L, complete cds | 0 |
| 10344 | I:2859338:11B02:D03 | XM_005052 | *Homo sapiens* angiopoietin 1 (ANGPT1), mRNA | 1.3E-97 |
| 832 | M00021649B:D05 | XM_004628 | *Homo sapiens* hypoxia-inducible protein 2 (HIG2), mRNA | 0 |
| 12071 | I:1798283:06A01:D06 | S72481 | pantophysin [human, keratinocyte line HaCaT, mRNA, 2106 nt] | 0 |
| 12271 | I:1445767:04A01:H06 | X12701 | *H. sapiens* mRNA for endothelial plasminogen activator inhibitor PAI | 1.8E-130 |
| 433 | I:1526282:03A01:E05 | XM_033627 | *Homo sapiens* glycoprotein (transmembrane) nmb (GPNMB), mRNA | 3.7E-117 |
| 20917 | RG:222350:10007:C12 | X00663 | Human mRNA fragment for epidermal growth factor (EGF) receptor | 1.7E-122 |
| 25810 | 035JN004.B07 | X00588 | Human mRNA for precursor of epidermal growth factor receptor | 0 |
| 12039 | I:3506985:07A01:D06 | M24795 | Human CD36 antigen mRNA, complete cds | 0 |
| 25499 | 035JN005.G07 | XM_028224 | *Homo sapiens* N-acetylglucosamine-phosphate mutase (AGM1), mRNA | 0 |
| 25557 | 035JN013.D07 | BC010135 | *Homo sapiens*, cyclin C, clone IMAGE: 4106819, mRNA | 0 |
| 9917 | I:1283532:05A01:G09 | XM_004148 | *Homo sapiens* 5T4 oncofetal trophoblast glycoprotein (5T4), mRNA | 2.4E-70 |
| 19505 | RG:204653:10007:A10 | XM_003789 | *Homo sapiens* colony stimulating factor 1 receptor, formerly McDonough feline sarcoma viral (v-fms) oncogene homolog (CSF1R), mRNA | 0 |
| 17491 | RG:277866:10008:B07 | XM_003789 | *Homo sapiens* colony stimulating factor 1 receptor, formerly McDonough feline sarcoma viral (v-fms) oncogene homolog (CSF1R), mRNA | 0 |
| 10683 | I:1686726:06A01:F10 | XM_003789 | *Homo sapiens* colony stimulating factor 1 receptor, formerly McDonough feline sarcoma viral (v-fms) oncogene homolog (CSF1R), mRNA | 0 |
| 1936 | M00008020C:H09 | X68277 | *H. sapiens* CL 100 mRNA for protein tyrosine phosphatase | 0 |
| 828 | M00021638B:F03 | X68277 | *H. sapiens* CL 100 mRNA for protein tyrosine phosphatase | 0 |
| 9558 | I:1824443:05B02:C08 | XM_003708 | *Homo sapiens* gamma-aminobutyric acid (GABA) A receptor, pi (GABRP), mRNA | 0 |
| 20164 | I:1997963:14B02:B05 | XM_003631 | *Homo sapiens* solute carrier family 25 (mitochondrial carrier; adenine nucleotide translocator), member 4 (SLC25A4), mRNA | 0 |
| 969 | NIH50_40026 | BC008664 | *Homo sapiens*, clone MGC: 9281 IMAGE: 3871960, mRNA, complete cds | 0 |
| 9910 | I:1805840:05B01:C09 | XM_003399 | *Homo sapiens* mannosidase, beta A, lysosomal (MANBA), mRNA | 0 |
| 2427 | M00005767D:B03 | XM_047441 | *Homo sapiens* RAP1, GTP-GDP dissociation stimulator 1 (RAP1GDS1), mRNA | 0 |
| 19990 | RG:1056692:10012:C11 | XM_003450 | *Homo sapiens* cyclin G associated kinase (GAK), mRNA | 0 |

TABLE 18-continued

| SPOTID | SAMPLE ID | GENBANK NO | GENBANK DESCRIPTION | GENBANK SCORE |
|---|---|---|---|---|
| 20605 | I:690313:16A01:G12 | XM_011152 | Homo sapiens insulin-like growth factor binding protein 7 (IGFBP7), mRNA | 0 |
| 10650 | I:2456393:07B01:E10 | AK001580 | Homo sapiens cDNA FLJ10718 fis, clone NT2RP3001096, weakly similar to Rattus norvegicus leprecan mRNA | 0 |
| 25963 | 035JN022.G01 | X53002 | Human mRNA for integrin beta-5 subunit | 0 |
| 25562 | 035JN015.F07 | X53002 | Human mRNA for integrin beta-5 subunit | 0 |
| 9377 | I:2782593:12A01:A02 | X60656 | H. sapiens mRNA for elongation factor 1-beta | 1.4E−46 |
| 17618 | I:707667:15B01:A08 | XM_002273 | Homo sapiens inhibitor of DNA binding 2, dominant negative helix-loop-helix protein (ID2), mRNA | 3.5E−117 |
| 12136 | I:3208994:03B01:D06 | U16267 | Human AMP deaminase isoform L, alternatively spliced (AMPD2) mRNA, exons 1A, 2 and 3, partial cds | 0 |
| 17373 | I:1538189:14A02:G07 | XM_046818 | Homo sapiens similar to receptor tyrosine kinase-like orphan receptor 1 (H. sapiens) (LOC92711), mRNA | 8.3E−123 |
| 18577 | RG:503209:10010:A09 | XM_049305 | Homo sapiens Lysosomal-associated multispanning membrane protein-5 (LAPTM5), mRNA | 0 |
| 3143 | M00001605D:C02 | BC003107 | Homo sapiens, inhibitor of DNA binding 3, dominant negative helix-loop-helix protein, clone MGC: 1988 IMAGE: 3543936, mRNA, complete | 1.7E−88 |
| 17737 | RG:155066:10006:E02 | AL050147 | Homo sapiens mRNA; cDNA DKFZp586E0820 (from clone DKFZp586E0820); partial cds | 0 |
| 20029 | I:1923613:17A01:G11 | AF113123 | Homo sapiens carbonyl reductase mRNA, complete cds | 0 |
| 18537 | NIH50_40304 | BC001380 | Homo sapiens, succinate dehydrogenase complex, subunit A, flavoprotein (Fp), clone MGC: 1484 IMAGE: 3051442, mRNA, complete cds | 0 |
| 10090 | NIH50_40304 | | | |
| 12102 | I:2832414:11B01:C06 | XM_048045 | Homo sapiens katanin p80 (WD40-containing) subunit B1 (KATNB1), mRNA | 0 |
| 8487 | I:1375115:05A01:D01 | BC001174 | Homo sapiens, exostoses (multiple) 1, clone MGC: 2129 IMAGE: 3502232, mRNA, complete cds | 0 |
| 9252 | I:1673876:06B01:B02 | BC000917 | Homo sapiens, clone MGC: 5184 IMAGE: 3048750, mRNA, complete cds | 0 |
| 25605 | 035JN021.D01 | BC000671 | Homo sapiens, claudin 4, clone MGC: 1778 IMAGE: 3349211, mRNA, complete cds | 0 |
| 29652 | M00001610C:D05 | BC000588 | Homo sapiens, HIRA-interacting protein 3, clone MGC: 1814 IMAGE: 3345739, mRNA, complete cds | 0 |
| 10858 | I:2458933:04B01:E04 | X97544 | H. sapiens mRNA for TIM17 preprotein translocase | 8.7E−62 |
| 1261 | M00023419C:B06 | U89606 | Human pyridoxal kinase mRNA, complete cds | 0 |
| 4156 | 2243-4 | X93334 | Homo sapiens mitochondrial DNA, complete genome | 0 |
| 3452 | 2243-1 | X93334 | Homo sapiens mitochondrial DNA, complete genome | 0 |
| 2748 | 2242-6 | X93334 | Homo sapiens mitochondrial DNA, complete genome | 0 |
| 2046 | 2248-3 | X93334 | Homo sapiens mitochondrial DNA, complete genome | 0 |
| 2044 | 2242-4 | X93334 | Homo sapiens mitochondrial DNA, complete genome | 0 |
| 1342 | 2248-2 | X93334 | Homo sapiens mitochondrial DNA, complete genome | 0 |

TABLE 18-continued

| SPOTID | SAMPLE ID | GENBANK NO | GENBANK DESCRIPTION | GENBANK SCORE |
|---|---|---|---|---|
| 1326 | 2244-3 | X93334 | *Homo sapiens* mitochondrial DNA, complete genome | 0 |
| 9981 | I:1720149:06A01:G09 | AF069604 | *Homo sapiens* myosin light chain kinase isoform 4 (MLCK) mRNA, partial cds | 0 |
| 27917 | 035JN002.H04 | XM_015978 | *Homo sapiens* hypothetical protein FLJ22969 (FLJ22969), mRNA | 1.8E−92 |
| 8488 | I:1808529:05B01:D01 | AJ293647 | *Homo sapiens* partial IL4RA gene for interleukin-4 receptor alfa chain, exon 11, ECSSQV allele | 1.1E−125 |
| 22793 | M00057283C:D06 | AF161410 | *Homo sapiens* HSPC292 mRNA, partial cds | 0 |
| 26883 | 035JN005.C03 | AF161410 | *Homo sapiens* HSPC292 mRNA, partial cds | 0 |
| 11540 | I:1909488:10B01:B11 | XM_027739 | *Homo sapiens* duodenal cytochrome b (FLJ23462), mRNA | 0 |
| 17707 | I:489882:14A01:F02 | X99474 | *H. sapiens* mRNA for chloride channel, ClC-6c | 0 |
| 20649 | NIH50_41452 | Z14136 | *H. sapiens* gene for spermidine/spermine N1-acetyltransferase | 0 |
| 24004 | M00056163C:H09 | AF107495 | *Homo sapiens* FWP001 and putative FWP002 mRNA, complete cds | 0 |
| 11836 | I:1806769:01B02:F11 | X93036 | *H. sapiens* mRNA for MAT8 protein | 0 |
| 24932 | M00054963C:C09 | M26152 | *Homo sapiens* serum amyloid A (SAA) mRNA, complete cds | 0 |
| 19143 | RG:149960:10006:D04 | AK003448 | *Mus musculus* 18 days embryo cDNA, RIKEN full-length enriched library, clone: 1110004P15, full insert sequence | 8.9E−21 |
| 26257 | 035JN013.B08 | J04056 | Human carbonyl reductase mRNA, complete cds | 0 |
| 21239 | M00054679B:B03 | J02619 | Human Z type alpha-1-antitrypsin gene, complete cds (exons 2-5) | 0 |
| 16959 | I:1426031:14B01:B07 | AY035783 | *Homo sapiens* laminin 5 beta 3 subunit (LAMB3) mRNA, complete cds | 3.8E−121 |
| 2568 | M00022158D:C11 | XM_036609 | *Homo sapiens* laminin, beta 3 (nicein (125 kD), kalinin (140 kD), BM600 (125 kD)) (LAMB3), mRNA | 0 |
| 25936 | 035JN020.A07 | XM_036608 | *Homo sapiens* laminin, beta 3 (nicein (125 kD), kalinin (140 kD), BM600 (125 kD)) (LAMB3), mRNA | 0 |
| 23041 | M00054797C:G10 | XM_046649 | *Homo sapiens* nuclear factor of kappa light polypeptide gene enhancer in B-cells inhibitor, alpha (NFKBIA), mRNA | 0 |
| 9206 | I:1822716:05B01:C08 | BC008059 | *Homo sapiens*, clone IMAGE: 2967491, mRNA | 0 |
| 25105 | M00054824C:H04 | BC009110 | *Homo sapiens*, clone MGC: 17355 IMAGE: 3453825, mRNA, complete cds | 0 |
| 24779 | M00057061D:G07 | | | |
| 22451 | M00043372B:B06 | X00947 | Human alpha 1-antichymotrypsin gene fragment | 0 |
| 22291 | M00054785D:G05 | X00947 | Human alpha 1-antichymotrypsin gene fragment | 0 |
| 21143 | M00055146A:D11 | | | |
| 24751 | M00054676B:D07 | X03083 | Human lactate dehydrogenase-A gene exon 7 and 3' flanking region | 0 |
| 24294 | M00056163D:E01 | X03083 | Human lactate dehydrogenase-A gene exon 7 and 3' flanking region | 9.4E−110 |
| 24006 | M00056163D:E01 | X03083 | Human lactate dehydrogenase-A gene exon 7 and 3' flanking region | 0 |
| 25678 | 035Jn031.H01 | AK001670 | *Homo sapiens* cDNA FLJ10808 fis, clone NT2RP4000879, weakly similar to UBIQUITIN-ACTIVATING ENZYME E1 | 4.9E−53 |
| 22027 | M00056534C:E08 | XM_003512 | *Homo sapiens* amphiregulin (schwannoma-derived growth factor) (AREG), mRNA | 0 |
| 29495 | 035JN022.E12 | D83761 | *Homo sapiens* mRNA for mother against dpp (Mad) related protein, complete cds | 0 |

TABLE 18-continued

| SPOTID | SAMPLE ID | GENBANK NO | GENBANK DESCRIPTION | GENBANK SCORE |
|---|---|---|---|---|
| 24577 | M00056654B:G02 | XM_038306 | Homo sapiens dual specificity phosphatase 6 (DUSP6), mRNA | 0 |
| 23527 | M00055865C:D04 | | | |
| 17090 | I:341491:13B01:A01 | BC004490 | Homo sapiens, v-fos FBJ murine osteosarcoma viral oncogene homolog, clone MGC: 11074 IMAGE: 3688670, mRNA, complete cds | 3.8E−98 |
| 25137 | M00057167A:C07 | | | |
| 23772 | M00056360A:E07 | BC004490 | Homo sapiens, v-fos FBJ murine osteosarcoma viral oncogene homolog, clone MGC: 11074 IMAGE: 3688670, mRNA, complete cds | 0 |
| 1659 | M00001350B:D10 | BC004490 | Homo sapiens, v-fos FBJ murine osteosarcoma viral oncogene homolog, clone MGC: 11074 IMAGE: 3688670, mRNA, complete cds | 0 |
| 8497 | I:2170638:05A01:A07 | BC006169 | Homo sapiens, Similar to SH3-domain binding protein 5 (BTK-associated), clone MGC: 13234 IMAGE: 4025362, mRNA, complete cds | 5.2E−125 |
| 25272 | M00054621A:D09 | AF161435 | Homo sapiens HSPC317 mRNA, partial cds | 0 |
| 21216 | M00056194B:G06 | XM_002844 | Homo sapiens procollagen-lysine, 2-oxoglutarate 5-dioxygenase (lysine hydroxylase) 2 (PLOD2), mRNA | 0 |
| 11939 | I:2938757:02A02:B05 | D43767 | Human mRNA for chemokine, complete cds | 0 |
| 9191 | I:1421929:05A01:D02 | X63629 | H. sapiens mRNA for p cadherin | 2.4E−90 |
| 3429 | 2024-3 | AF002697 | Homo sapiens E1B 19K/Bcl-2-binding protein Nip3 mRNA, nuclear gene encoding mitochondrial protein, complete cds | 0 |
| 2725 | 2024-1 | AF002697 | Homo sapiens E1B 19K/Bcl-2-binding protein Nip3 mRNA, nuclear gene encoding mitochondrial protein, complete cds | 0 |
| 19923 | I:1001356:13A01:B11 | BC006318 | Homo sapiens, erythrocyte membrane protein band 4.9 (dematin), clone MGC: 12740 IMAGE: 4125804, mRNA, complete cds | 1.7E−103 |
| 20457 | I:1923289:19A01:E06 | XM_035603 | Homo sapiens gap junction protein, beta 5 (connexin 31.1) (GJB5), mRNA | 0 |
| 24773 | M00057055D:B11 | | | |
| 24119 | M00042886D:H10 | BC006260 | Homo sapiens, Similar to N-myc downstream regulated, clone MGC: 11293 IMAGE: 3946764, mRNA, complete cds | 4.4E−114 |
| 3908 | M00027080A:E06 | M60756 | Human histone H2B.1 mRNA, 3' end | 0 |
| 8560 | I:2346704:06B01:H01 | AJ000334 | Homo sapiens mRNA for cytosolic asparaginyl-tRNA synthetase | 0 |
| 24588 | M00055411A:C10 | L19779 | Homo sapiens histone H2A.2 mRNA, complete cds | 0 |
| 4047 | M00007997C:B08 | XM_009091 | Homo sapiens glycogen synthase 1 (muscle) (GYS1), mRNA | 0 |
| 28344 | 035JN011.E11 | XM_050471 | Homo sapiens glycogen synthase 1 (muscle) (GYS1), mRNA | 0 |
| 27561 | 035JN001.F04 | XM_001472 | Homo sapiens v-jun avian sarcoma virus 17 oncogene homolog (JUN), mRNA | 0 |
| 3272 | M00022165C:E12 | NM_001024 | Homo sapiens ribosomal protein S21 (RPS21), mRNA | 0 |
| 26735 | 035JN030.A08 | XM_010408 | Homo sapiens RAB9-like protein (RAB9L), mRNA | 0 |
| 24900 | M00054500D:C08 | BC004427 | Homo sapiens, proteasome (prosome, macropain) subunit, alpha type, 7, clone MGC: 3755 IMAGE: 2819923, mRNA, complete cds | 0 |

TABLE 18-continued

| SPOTID | SAMPLE ID | GENBANK NO | GENBANK DESCRIPTION | GENBANK SCORE |
|---|---|---|---|---|
| 9472 | I:2510171:04B01:H08 | X04503 | Human SLPI mRNA fragment for secretory leucocyte protease inhibitor | 0 |
| 9979 | I:1623318:06A01:F09 | L31409 | *Homo sapiens* creatine transporter mRNA, complete cds | 2.2E−45 |
| 21996 | M00042467B:B04 | L00160 | Human phosphoglycerate kinase (pgk) mRNA, exons 2 to last | 0 |
| 22312 | M00055035D:F05 | | | |
| 11327 | I:3139773:05A01:H11 | L00160 | Human phosphoglycerate kinase (pgk) mRNA, exons 2 to last | 2.6E−21 |
| 18240 | RG:1927470:10015:H08 | V00572 | Human mRNA encoding phosphoglycerate kinase | 0 |
| 21922 | M00054848A:D12 | AF139065 | *Homo sapiens* desmoplakin I mRNA, partial cds | 0 |
| 22290 | M00057002D:H01 | | | |
| 10390 | I:1405391:03B02:C09 | AF056979 | *Homo sapiens* clone YAN1 interferon-gamma receptor mRNA, complete cds | 0 |
| 2212 | M00008098B:F06 | U19247 | *Homo sapiens* interferon-gamma receptor alpha chain gene, exon 7 and complete cds | 0 |
| 20213 | RG:221172:10007:C11 | S74774 | p59fyn(T) = OKT3-induced calcium influx regulator [human, Jurkat J6 T cell line, mRNA Partial, 1605 nt] | 2.9E−103 |
| 24955 | M00055929D:D04 | | | |
| 19574 | I:635178:13B02:C10 | XM_033944 | *Homo sapiens* superoxide dismutase 2, mitochondrial (SOD2), mRNA | 0 |
| 19969 | RG:501476:10010:A05 | U14394 | Human tissue inhibitor of metalloproteinases-3 mRNA, complete cds | 0 |
| 8570 | I:1696224:06B01:E07 | X70684 | *C. aethiops* mRNA for heat shock protein 70 | 5.6E−25 |
| 18519 | I:1997703:13A01:D09 | X52947 | Human mRNA for cardiac gap junction protein | 0 |
| 9616 | I:3200341:06B02:H02 | Y00106 | Human gene for beta-adrenergic receptor (beta-2 subtype) | 0 |
| 22334 | M00055067D:H12 | | | |
| 17459 | I:2056395:13A02:B07 | M77349 | Human transforming growth factor-beta induced gene product (BIGH3) mRNA, complete cds | 2.5E−121 |
| 25193 | M00056763B:A12 | X68277 | *H. sapiens* CL 100 mRNA for protein tyrosine phosphatase | 0 |
| 25191 | M00056763B:A12 | X68277 | *H. sapiens* CL 100 mRNA for protein tyrosine phosphatase | 0 |
| 9448 | I:2455617:04B01:D02 | XM_051799 | *Homo sapiens* guanosine monophosphate reductase (GMPR), mRNA | 0 |
| 25224 | RG:950682:10003:D06 | BC002536 | Homo sapiens, phosphofructokinase, platelet, clone MGC: 2192 IMAGE: 3140233, mRNA, complete cds | 0 |
| 20218 | RG:2158297:10016:E11 | BC002536 | Homo sapiens, phosphofructokinase, platelet, clone MGC: 2192 IMAGE: 3140233, mRNA, complete cds | 0 |
| 3089 | NIH50_26184 | D25328 | Human mRNA for platelet-type phosphofructokinase, complete cds | 2E−108 |
| 23985 | NIH50_26184 | | | |
| 19953 | NIH50_26184 | D25328 | Human mRNA for platelet-type phosphofructokinase, complete cds | 2E−108 |
| 11506 | NIH50_26184 | | | |
| 22362 | M00056349A:F08 | M10546 | Human mitochondrial DNA, fragment M1, encoding transfer RNAs, cytochrome oxidase I, and 2 URFs | 1.2E−86 |
| 25516 | 035JN011.G01 | XM_011470 | *Homo sapiens* myristoylated alanine-rich protein kinase C substrate (MARCKS, 80K-L) (MACS), mRNA | 0 |
| 25757 | 037XN005.H07 | AF017116 | *Homo sapiens* type-2 phosphatidic acid phosphohydrolase (PAP2) mRNA, complete cds | 0 |
| 24814 | M00042773B:E09 | M17733 | Human thymosin beta-4 mRNA, complete cds | 0 |

TABLE 18-continued

| SPOTID | SAMPLE ID | GENBANK NO | GENBANK DESCRIPTION | GENBANK SCORE |
|---|---|---|---|---|
| 21994 | M00042465B:E04 | M17733 | Human thymosin beta-4 mRNA, complete cds | 0 |
| 27117 | 037XN001.H03 | BC001631 | Homo sapiens, prothymosin beta 4, clone MGC: 2219 IMAGE: 3536637, mRNA, complete cds | 0 |
| 24681 | NIH50_41452 | | | |
| 22745 | M00056592A:B08 | NM_003739 | Homo sapiens aldo-keto reductase family 1, member C3 (3-alpha hydroxysteroid dehydrogenase, type II) (AKR1C3), mRNA | 0 |
| 24233 | M00055873C:B06 | | | |
| 2001 | M00001381A:F03 | XM_035387 | Homo sapiens ribosomal protein, large, P1 (RPLP1), mRNA | 0 |
| 21179 | NIH50_43550 | | | |
| 17147 | NIH50_43550 | AK026515 | Homo sapiens cDNA: FLJ22862 fis, clone KAT01966, highly similar to HSLDHAR Human mRNA for lactate dehydrogenase-A | 0 |
| 8700 | NIH50_43550 | | | |
| 21214 | M00056193B:D06 | BC006260 | Homo sapiens, Similar to N-myc downstream regulated, clone MGC: 11293 IMAGE: 3946764, mRNA, complete cds | 0 |
| 26422 | 037XN003.D08 | BC006260 | Homo sapiens, Similar to N-myc downstream regulated, clone MGC: 11293 IMAGE: 3946764, mRNA, complete cds | 0 |
| 22837 | M00055891C:B09 | | | |
| 21965 | M00057029A:G09 | | | |
| 25541 | 035JN013.D01 | AK026310 | Homo sapiens cDNA: FLJ22657 fis, clone HSI07791, highly similar to HUMCYB5 Human cytochrome b5 mRNA | 0 |
| 18302 | I:1738248:09B02:G08 | XM_016114 | Homo sapiens hypothetical protein FLJ22501 (FLJ22501), mRNA | 0 |
| 24049 | M00054706B:G04 | AF107495 | Homo sapiens FWP001 and putative FWP002 mRNA, complete cds | 0 |
| 26326 | 035JN023.D08 | AK025906 | Homo sapiens cDNA: FLJ22253 fis, clone HRC02763 | 0 |
| 2254 | M00004085C:C02 | AK025703 | Homo sapiens cDNA: FLJ22050 fis, clone HEP09454 | 0 |
| 10296 | I:2868216:07B02:D09 | AK025703 | Homo sapiens cDNA: FLJ22050 fis, clone HEP09454 | 0 |
| 20044 | I:2547084:09B01:F05 | XM_016847 | Homo sapiens hypothetical protein FLJ22002 (FLJ22002), mRNA | 0 |
| 28806 | 035JN028.D05 | AK025504 | Homo sapiens cDNA: FLJ21851 fis, clone HEP01962 | 0 |
| 17566 | I:446969:17B02:G07 | AK023217 | Homo sapiens cDNA FLJ13155 fis, clone NT2RP3003433 | 2E-115 |
| 19005 | I:2674167:09A02:G09 | AK022968 | Homo sapiens cDNA FLJ12906 fis, clone NT2RP2004373 | 0 |
| 3567 | M00023369D:C05 | | | |
| 21983 | M00057081B:H03 | | | |
| 458 | M00022134B:E08 | XM_037412 | Homo sapiens hypothetical gene supported by BC008993 (LOC91283), mRNA | 0 |
| 22331 | M00057138A:E11 | | | |
| 21411 | M00055833D:B03 | | | |
| 22972 | M00056956D:B01 | | | |
| 24533 | RG:1643392:10014:C11 | | | |
| 24853 | M00056617D:F07 | AK020869 | Mus musculus adult retina cDNA, RIKEN full-length enriched library, clone: A930017A02, full insert sequence | 6.5E-59 |
| 23753 | M00054915A:G02 | | | |
| 21502 | M00056193B:D06 | | | |
| 18180 | RG:39422:10005:B02 | | | |
| 23918 | M00056278C:E03 | | | |
| 24144 | RG:1982961:20001:H05 | | | |
| 19996 | RG:1283072:10012:F11 | BC009107 | Homo sapiens, clone MGC: 17352 IMAGE: 3449913, mRNA, complete cds | 0 |
| 11528 | I:1899534:10B01:D05 | | | |
| 20506 | I:1969044:18B01:E12 | AB048286 | Homo sapiens GS1999full mRNA, complete cds | 0 |

TABLE 18-continued

| SPOTID | SAMPLE ID | GENBANK NO | GENBANK DESCRIPTION | GENBANK SCORE |
|---|---|---|---|---|
| 23833 | RG:1656861:10014:E10 | | | |
| 20042 | I:1873176:09B01:E05 | BC001909 | *Homo sapiens*, clone IMAGE: 3537447, mRNA, partial cds | 0 |
| 24977 | M00055820D:F01 | | | |
| 11646 | I:1723142:08B02:G11 | AK014612 | *Mus musculus* 0 day neonate skin cDNA, RIKEN full-length enriched library, clone: 4633401I05, full insert sequence | 4.6E−45 |
| 24872 | RG:773612:10011:D06 | | | |
| 10577 | I:2174196:08A01:A10 | | | |
| 21710 | RG:1091554:10003:G01 | | | |
| 18556 | RG:31082:10004:F09 | | | |
| 29433 | 035JN014.F12 | AK001805 | *Homo sapiens* cDNA FLJ10943 fis, clone OVARC1001360 | 0 |
| 29273 | 037XN005.F12 | | | |
| 28763 | 035JN018.G11 | AJ310543 | *Homo sapiens* mRNA for EGLN1 protein | 1.9E−40 |
| 27887 | RG:2364147:8119908:A10 | | | |
| 27450 | 035JN032.F09 | | | |
| 27255 | 035JN006.E09 | XM_027456 | *Homo sapiens* hypothetical gene supported by AK000584 (LOC89942), mRNA | 1.2E−57 |
| 27226 | 035JN004.F09 | | | |
| 26550 | 035JN008.D08 | | | |
| 26508 | 035JN004.G02 | | | |
| 26483 | RG:2377371:8119908:C08 | | | |
| 26334 | 035JN023.H08 | AF364547 | *Homo sapiens* methylmalonyl-CoA epimerase mRNA, complete cds; nuclear gene for mitochondrial product | 0 |
| 26027 | 035JN030.G01 | | | |
| 25977 | 035JN022.F07 | | | |
| 25965 | 035JN022.H01 | | | |
| 25844 | 035JN008.C07 | | | |
| 25834 | 035JN008.F01 | AB048289 | *Bos taurus lae* mRNA for lipoate-activating enzyme, complete cds | 3.1E−35 |
| 25816 | 035JN004.E07 | | | |
| 25746 | 037XN007.B07 | | | |
| 25742 | 037XN007.H01 | | | |
| 25741 | 037XN005.H01 | | | |
| 25712 | 037XN003.A07 | | | |
| 25642 | 035Jn027.F01 | | | |
| 25621 | 035JN021.D07 | AK027321 | *Homo sapiens* cDNA FLJ14415 fis, clone HEMBA1004889, weakly similar to Human C3f mRNA | 0 |
| 25614 | 035JN023.H01 | | | |
| 25603 | 035JN021.C01 | | | |
| 25556 | 035JN015.C07 | | | |
| 25555 | 035JN013.C07 | | | |
| 25540 | 035JN015.C01 | | | |
| 23576 | RG:1984769:20002:D10 | | | |
| 22566 | RG:1996656:20003:C03 | | | |
| 9036 | DD182 | | | |
| 4164 | M00007932B:E06 | | | |
| 4146 | 2179-5 | | | |
| 4091 | M00026845A:E01 | | | |
| 4072 | M00023398A:G12 | | | |
| 4022 | M00022127D:B06 | | | |
| 3965 | M00005406A:f04 | | | |
| 3954 | M00005400B:E1 | | | |
| 3872 | M00007974D:B04 | | | |
| 3869 | M00003868C:A03 | | | |
| 3838 | M00007052A:C09 | XM_048272 | *Homo sapiens* similar to Ras-related GTP-binding protein (*H. sapiens*) (LOC92951), mRNA | 0 |
| 3806 | 2168-2 | | | |
| 3798 | 2138-4 | | | |
| 3792 | 2171-5 | | | |
| 3788 | 2156-4 | | | |
| 3767 | M00001355D:H12 | | | |
| 3458 | M00007160D:E10 | | | |
| 3251 | M00005471A:a04 | | | |
| 3194 | DF821 | | | |
| 3102 | 2167-1 | | | |
| 3094 | 2138-3 | | | |

TABLE 18-continued

| SPOTID | SAMPLE ID | GENBANK NO | GENBANK DESCRIPTION | GENBANK SCORE |
|---|---|---|---|---|
| 2671 | M00023431A:D02 | | | |
| 2634 | M00008025D:A04 | | | |
| 2567 | M00008061B:A12 | | | |
| 2317 | M00001502D:E09 | | | |
| 1958 | M00023296B:B09 | | | |
| 1680 | 2169-5 | | | |
| 1625 | M00001542C:G08 | | | |
| 1445 | M00023335C:C09 | | | |
| 1320 | 2207-5 | | | |
| 974 | 2161-1 | | | |
| 726 | DO15 | | | |
| 718 | ER418 | | | |
| 703 | M00004189D:A11 | | | |
| 652 | M00007070A:C08 | | | |
| 630 | 2203-2 | | | |
| 593 | M00001373A:A06 | X93036 | *H. sapiens* mRNA for MAT8 protein | 0 |
| 532 | M00022005A:H05 | | | |
| 272 | 2168-5 | | | |
| 256 | M00001406C:H12 | | | |
| 57 | M00023371B:H02 | | | |

TABLE 19

| SEQ ID NO. | SPOT ID | 2D T4-2/ 2D S1 | 3D T4-2/ 3D S1 | 3D S1/ 2D S1 | 3D T4-2/ 2D T4-2 | 3D T4-2/ EGFR Ab | 3D T4-2/ B1 Integrin Ab | 3D T4-2/ Tyr |
|---|---|---|---|---|---|---|---|---|
| 2506 | 10594 | 0.6 | 2.2 | 0.6 | 1.9 | 3.0 | 1.0 | 2.9 |
| 2507 | 21851 | 1.0 | 1.0 | 1.0 | 3.5 | 1.3 | 1.0 | 1.0 |
| 2508 | 20990 | 1.6 | 4.6 | 1.0 | 1.5 | 1.0 | 1.0 | 1.0 |
| 2509 | 18641 | 1.0 | 0.6 | 2.6 | 1.7 | 1.0 | 1.6 | 1.0 |
| 2510 | 17229 | 0.3 | 0.8 | 1.0 | 2.1 | 1.0 | 1.0 | 1.0 |
| 2511 | 25930 | 1.0 | 1.0 | 1.0 | 1.0 | 1.0 | 1.0 | 1.0 |
| 2512 | 20701 | 1.6 | 2.9 | 1.3 | 2.7 | 4.5 | 1.9 | 5.8 |
| 2513 | 20346 | 1.7 | 2.7 | 1.4 | 2.6 | 4.3 | 2.0 | 5.2 |
| 2514 | 21247 | 1.0 | 4.4 | 1.5 | 3.0 | 3.4 | 2.6 | 4.7 |
| 2515 | 23062 | 0.6 | 2.5 | 0.6 | 1.8 | 3.3 | 1.4 | 2.7 |
| 2516 | 25666 | 1.0 | 2.9 | 0.6 | 2.0 | 3.6 | 1.0 | 2.3 |
| 2517 | 19001 | 8.5 | 14.2 | 1.0 | 1.0 | 4.8 | 1.7 | 8.0 |
| 2518 | 10897 | 1.0 | 3.1 | 4.5 | 1000.0 | 13.3 | 4.6 | 18.4 |
| 2519 | 1960 | 0.3 | 1.5 | 3.0 | 13.7 | 3.9 | 2.4 | 4.9 |
| 2520 | 26381 | 1.0 | 1.0 | 1.0 | 0.9 | 1.0 | 1.0 | 1.0 |
| 2521 | 26719 | 0.4 | 1.0 | 0.6 | 2.8 | 1.2 | 1.7 | 1.0 |
| 2522 | 27152 | 4.2 | 3.0 | 2.2 | 1.5 | 1.3 | 1.0 | 1.3 |
| 2523 | 10926 | 0.7 | 1.9 | 0.9 | 2.1 | 3.7 | 1.5 | 3.3 |
| 2524 | 28980 | 0.6 | 1.4 | 1.0 | 2.4 | 1.0 | 1.0 | 1.0 |
| 2525 | 1236 | 1.0 | 2.8 | 0.8 | 2.1 | 2.2 | 1.8 | 3.2 |
| 2526 | 29350 | 0.5 | 0.6 | 1.2 | 2.1 | 1.4 | 1.0 | 1.0 |
| 2527 | 26242 | 1.0 | 1.0 | 0.6 | 2.2 | 1.0 | 1.0 | 2.0 |
| 2528 | 4098 | 1.4 | 3.9 | 0.6 | 2.1 | 2.7 | 1.3 | 3.1 |
| 2529 | 17432 | 0.4 | 0.3 | 2.4 | 2.1 | 0.3 | 0.9 | 0.3 |
| 2530 | 1785 | 0.5 | 0.4 | 2.4 | 2.0 | 0.3 | 1.0 | 0.3 |
| 2531 | 28856 | 8.5 | 0.9 | 2.5 | 0.3 | 0.6 | 1.0 | 0.5 |
| 2532 | 18791 | 1.0 | 0.2 | 0.3 | 4.1 | 1.0 | 1.0 | 1.3 |
| 2533 | 22950 | 3.9 | 4.1 | 1.2 | 1.0 | 2.1 | 1.0 | 2.4 |
| 2534 | 1882 | 2.4 | 4.1 | 0.9 | 1.8 | 3.2 | 1.5 | 4.7 |
| 2535 | 23886 | 1.0 | 1.0 | 1.2 | 2.1 | 1.0 | 1.0 | 1.0 |
| 2536 | 24995 | 2.0 | 1.6 | 2.1 | 1.0 | 1.0 | 1.0 | 1.0 |
| 2537 | 24477 | 1.0 | 1.9 | 1.0 | 4.2 | 2.7 | 1.3 | 1.8 |
| 2538 | 21681 | 1.7 | 7.1 | 0.6 | 2.0 | 2.8 | 1.0 | 3.6 |
| 2539 | 9557 | 1.6 | 7.5 | 0.8 | 1.0 | 3.0 | 1.0 | 2.5 |
| 2540 | 22033 | 2.8 | 3.7 | 1.0 | 0.9 | 2.2 | 1.0 | 2.7 |
| 2541 | 873 | 1.0 | 4.0 | 1.0 | 2.7 | 1.7 | 1.0 | 1.0 |
| 2542 | 17144 | 1.0 | 0.5 | 3.6 | 1.4 | 1.0 | 1.0 | 1.0 |
| 2543 | 26970 | 6.0 | 15.3 | 0.2 | 0.6 | 2.9 | 1.0 | 5.4 |
| 2544 | 21402 | 0.2 | 1.0 | 2.8 | 6.9 | 2.4 | 1.0 | 3.6 |
| 2545 | 27074 | 1.7 | 2.5 | 2.3 | 3.2 | 1.6 | 1.0 | 2.0 |
| 2546 | 10963 | 0.5 | 0.3 | 2.1 | 0.5 | 1.0 | 1.0 | 0.7 |
| 2547 | 29525 | 0.6 | 1.0 | 0.7 | 2.4 | 1.7 | 1.3 | 1.0 |
| 2548 | 25514 | 1000.0 | 1.0 | 1.0 | 1.0 | 0.5 | 1.0 | 1.0 |
| 2549 | 26612 | 0.4 | 0.5 | 1.6 | 2.8 | 0.8 | 1.0 | 0.8 |
| 2550 | 24600 | 1.6 | 2.7 | 1.0 | 2.0 | 1.0 | 1.2 | 1.4 |
| 2551 | 9741 | 2.3 | 5.0 | 1.0 | 2.2 | 1.7 | 1.0 | 1.0 |

TABLE 19-continued

| SEQ ID NO. | SPOT ID | 2D T4-2/ 2D S1 | 3D T4-2/ 3D S1 | 3D S1/ 2D S1 | 3D T4-2/ 2D T4-2 | 3D T4-2/ EGFR Ab | 3D T4-2/ B1 Integrin Ab | 3D T4-2/ Tyr |
|---|---|---|---|---|---|---|---|---|
| 2552 | 23689 | 1.0 | 2.6 | 0.8 | 1.8 | 2.3 | 1.0 | 2.7 |
| 2553 | 22352 | 1.0 | 2.9 | 0.7 | 1.6 | 2.4 | 1.0 | 2.4 |
| 2554 | 23806 | 1.0 | 0.4 | 1.3 | 2.3 | 1.0 | 1.4 | 1.4 |
| 2555 | 12285 | 1.0 | 1.0 | 1.0 | 1.0 | 0.8 | 1.0 | 0.5 |
| 2556 | 27638 | 0.6 | 1.0 | 0.8 | 2.2 | 2.1 | 1.0 | 1.0 |
| 2557 | 9663 | 1.0 | 1.0 | 1.0 | 1000.0 | 1.0 | 1.0 | 1.0 |
| 2558 | 26850 | 1.0 | 0.2 | 9.1 | 2.1 | 1.3 | 1.6 | 2.2 |
| 2559 | 10204 | 2.9 | 2.3 | 0.8 | 0.6 | 3.1 | 1.4 | 2.4 |
| 2560 | 1318 | 2.0 | 0.9 | 2.3 | 0.5 | 0.6 | 1.1 | 0.7 |
| 2561 | 25922 | 1.0 | 0.8 | 1.0 | 1.0 | 1.0 | 1.0 | 1.0 |
| 2562 | 26347 | 1.0 | 1.0 | 1.0 | 1.0 | 1.0 | 1.0 | 1.0 |
| 2563 | 20361 | 1.0 | 1.0 | 1.0 | 2.0 | 1.0 | 1.0 | 1.0 |
| 2564 | 28672 | 0.6 | 2.1 | 0.6 | 2.1 | 1.4 | 1.0 | 1.7 |
| 2565 | 25520 | 0.5 | 0.3 | 2.3 | 1.3 | 1.0 | 0.7 | 0.5 |
| 2566 | 1723 | 1.0 | 0.5 | 5.1 | 3.5 | 1.0 | 3.1 | 1.0 |
| 2567 | 28863 | 0.8 | 1.3 | 1.0 | 2.3 | 1.7 | 1.7 | 1.7 |
| 2568 | 25526 | 5.9 | 1.7 | 1.0 | 0.6 | 0.6 | 0.7 | 0.4 |
| 2569 | 27936 | 1.0 | 1.0 | 3.2 | 3.1 | 1.9 | 3.1 | 1.5 |
| 2570 | 26851 | 1.0 | 0.7 | 3.2 | 2.7 | 1.6 | 2.4 | 1.3 |
| 2571 | 25107 | 1.0 | 5.8 | 1.0 | 2.6 | 2.6 | 1.6 | 2.6 |
| 2572 | 24912 | 1.0 | 2.9 | 1.0 | 2.4 | 1.6 | 1.3 | 1.8 |
| 2573 | 25169 | 1.0 | 0.7 | 2.5 | 1.5 | 1.0 | 1.0 | 1.0 |
| 2574 | 25600 | 1.6 | 1.4 | 2.9 | 2.1 | 0.7 | 0.9 | 0.5 |
| 2575 | 28706 | 0.2 | 0.5 | 0.6 | 2.1 | 1.3 | 1.2 | 1.0 |
| 2576 | 26377 | 0.6 | 0.3 | 2.2 | 1.0 | 1.2 | 1.3 | 1.0 |
| 2577 | 19460 | 2.4 | 1.5 | 2.5 | 1.3 | 1.0 | 1.0 | 0.8 |
| 2578 | 25243 | 1.0 | 0.7 | 2.2 | 1.0 | 1.0 | 1.0 | 1.0 |
| 2579 | 20018 | 1.0 | 1.0 | 1.0 | 2.6 | 1.0 | 1.0 | 1.0 |
| 2580 | 918 | 1.0 | 1.7 | 1.3 | 2.1 | 2.0 | 1.6 | 2.4 |
| 2581 | 25027 | 1.0 | 1.0 | 1.0 | 1.0 | 1.0 | 1.0 | 1.0 |
| 2582 | 29089 | 0.6 | 0.5 | 0.8 | 2.1 | 1.0 | 1.0 | 1.0 |
| 2583 | 9141 | 1.0 | 1.0 | 1.0 | 1.0 | 1.0 | 1.0 | 1.0 |
| 2584 | 12005 | 1.0 | 1.0 | 2.2 | 1.0 | 1.0 | 1.0 | 1.0 |
| 2585 | 12148 | 1.0 | 1.0 | 1.0 | 1.0 | 1.0 | 1.0 | 1.0 |
| 2586 | 17394 | 0.4 | 0.6 | 2.1 | 2.0 | 1.0 | 1.0 | 1.0 |
| 2587 | 27017 | 2.8 | 3.3 | 0.8 | 1.0 | 2.4 | 1.8 | 2.8 |
| 2588 | 25809 | 1.0 | 1.0 | 1000.0 | 1.0 | 1.0 | 1.0 | 1.0 |
| 2589 | 8719 | 0.1 | 1.0 | 2.3 | 2.1 | 0.4 | 0.5 | 0.3 |
| 2590 | 21030 | 0.4 | 1.0 | 1.3 | 2.1 | 1.4 | 1.6 | 1.4 |
| 2591 | 11436 | 0.7 | 0.4 | 2.0 | 1.0 | 0.6 | 0.8 | 0.6 |
| 2592 | 10374 | 1.5 | 1.5 | 3.5 | 2.7 | 0.4 | 1.0 | 0.3 |
| 2593 | 19037 | 3.0 | 3.3 | 0.9 | 1.5 | 2.7 | 1.4 | 3.7 |
| 2594 | 398 | 1.6 | 6.9 | 1.1 | 3.3 | 2.4 | 1.0 | 4.5 |
| 2595 | 18773 | 1.9 | 5.1 | 1.0 | 3.9 | 3.8 | 2.0 | 6.1 |
| 2596 | 3583 | 0.5 | 0.7 | 1.0 | 2.0 | 2.5 | 1.0 | 1.5 |
| 2597 | 3418 | 1.8 | 3.2 | 1.2 | 2.4 | 1.6 | 1.0 | 1.2 |
| 2598 | 18985 | 9.2 | 3.1 | 1.0 | 0.6 | 2.3 | 1.1 | 2.5 |
| 2599 | 25861 | 3.4 | 1.5 | 2.0 | 0.8 | 0.8 | 0.9 | 0.6 |
| 2600 | 3317 | 0.9 | 2.3 | 1.0 | 3.4 | 1.9 | 1.0 | 1.0 |
| 2601 | 8743 | 0.2 | 0.7 | 1.0 | 4.3 | 1.8 | 1.0 | 1.7 |
| 2602 | 26240 | 0.2 | 1.0 | 1.0 | 5.3 | 1.9 | 1.9 | 1.1 |
| 2603 | 28562 | 0.3 | 0.2 | 2.0 | 1.0 | 0.5 | 0.5 | 0.6 |
| 2604 | 16877 | 1.0 | 2.6 | 1.1 | 2.6 | 1.7 | 1.5 | 1.3 |
| 2605 | 25955 | 1.0 | 1.0 | 1.0 | 1.0 | 1.0 | 1.0 | 1.0 |
| 2606 | 26308 | 0.2 | 0.4 | 1.0 | 2.2 | 0.7 | 0.8 | 0.6 |
| 2607 | 4140 | 1.9 | 6.7 | 0.7 | 2.1 | 3.0 | 1.0 | 3.5 |
| 2608 | 3436 | 1.8 | 6.3 | 0.6 | 2.2 | 3.1 | 1.3 | 3.3 |
| 2609 | 25612 | 1.0 | 12.5 | 1.0 | 1.0 | 2.1 | 1.0 | 2.9 |
| 2610 | 12257 | 1.0 | 1.0 | 2.0 | 1.0 | 0.8 | 0.9 | 0.8 |
| 2611 | 9111 | 0.5 | 0.5 | 2.2 | 1.3 | 1.5 | 1.0 | 0.7 |
| 2612 | 17620 | 0.3 | 0.8 | 1.0 | 3.2 | 2.7 | 2.1 | 1.0 |
| 2613 | 26025 | 1.0 | 2.9 | 1.1 | 2.2 | 2.3 | 1.0 | 2.6 |
| 2614 | 19271 | 0.5 | 1.3 | 0.7 | 2.2 | 1.6 | 1.2 | 1.5 |
| 2615 | 4151 | 0.4 | 4.2 | 1.2 | 11.1 | 4.2 | 1.0 | 2.9 |
| 2616 | 26569 | 0.7 | 2.2 | 0.8 | 2.9 | 2.3 | 1.7 | 2.6 |
| 2617 | 10344 | 1.0 | 1.0 | 1.0 | 1.0 | 1.0 | 1.0 | 1.0 |
| 2618 | 832 | 1.0 | 3.3 | 1.0 | 2.4 | 3.7 | 2.2 | 4.0 |
| 2619 | 12071 | 1.8 | 1.5 | 2.2 | 1.0 | 1.3 | 0.8 | 1.4 |
| 2620 | 12271 | 0.6 | 4.9 | 1.9 | 14.9 | 20.8 | 4.0 | 24.1 |
| 2621 | 11433 | 0.5 | 0.4 | 5.7 | 3.0 | 1.7 | 1.8 | 1.0 |
| 2622 | 20917 | 1.0 | 2.8 | 0.9 | 2.6 | 1.7 | 1.4 | 1.7 |
| 2623 | 25810 | 1.1 | 3.8 | 1.0 | 2.9 | 1.5 | 1.3 | 1.5 |
| 2624 | 12039 | 1.0 | 1.0 | 3.6 | 1.0 | 1.0 | 1.0 | 1.0 |
| 2625 | 25499 | 1.0 | 1.0 | 1.0 | 1.0 | 1.0 | 1.0 | 1.0 |
| 2626 | 25557 | 1.0 | 1.8 | 1.0 | 0.8 | 1.0 | 1.0 | 1.0 |

TABLE 19-continued

| SEQ ID NO. | SPOT ID | 2D T4-2/ 2D S1 | 3D T4-2/ 3D S1 | 3D S1/ 2D S1 | 3D T4-2/ 2D T4-2 | 3D T4-2/ EGFR Ab | 3D T4-2/ B1 Integrin Ab | 3D T4-2/ Tyr |
|---|---|---|---|---|---|---|---|---|
| 2627 | 9917 | 2.5 | 2.7 | 0.7 | 1.6 | 3.8 | 1.2 | 3.6 |
| 2628 | 19505 | 0.4 | 1.7 | 0.7 | 3.8 | 1.7 | 1.6 | 1.4 |
| 2629 | 17491 | 0.6 | 1.7 | 0.7 | 2.5 | 1.6 | 1.3 | 1.4 |
| 2630 | 10683 | 0.4 | 1.9 | 0.6 | 3.6 | 1.7 | 1.4 | 1.1 |
| 2631 | 1936 | 0.2 | 0.6 | 0.6 | 3.1 | 1.0 | 1.8 | 1.0 |
| 2632 | 828 | 0.1 | 1.0 | 0.5 | 3.0 | 1.0 | 1.7 | 1.2 |
| 2633 | 9558 | 1.0 | 1.0 | 1.0 | 1.0 | 1.0 | 1.0 | 1.0 |
| 2634 | 20164 | 2.0 | 1.1 | 2.5 | 1.7 | 1.0 | 1.0 | 0.8 |
| 2635 | 969 | 1.0 | 1.0 | 2.7 | 1.0 | 1.0 | 1.5 | 0.7 |
| 2636 | 9910 | 0.4 | 1.0 | 0.8 | 3.2 | 1.9 | 1.3 | 1.4 |
| 2637 | 2427 | 1.3 | 0.7 | 3.0 | 2.8 | 0.8 | 1.9 | 1.0 |
| 2638 | 19990 | 1.0 | 7.9 | 2.8 | 34.7 | 1.0 | 1.0 | 1.0 |
| 2639 | 20605 | 3.0 | 1.2 | 2.1 | 1.0 | 1.3 | 1.2 | 0.8 |
| 2640 | 10650 | 0.5 | 1.7 | 0.5 | 2.9 | 2.8 | 0.6 | 3.4 |
| 2641 | 25963 | 2.6 | 3.5 | 0.7 | 1.0 | 3.3 | 1.0 | 2.3 |
| 2642 | 25562 | 3.2 | 5.9 | 0.7 | 1.0 | 4.2 | 1.0 | 4.8 |
| 2643 | 9377 | 0.6 | 1.0 | 1.0 | 2.1 | 1.9 | 2.0 | 1.6 |
| 2644 | 17618 | 1.0 | 0.7 | 2.3 | 3.2 | 0.8 | 0.7 | 0.8 |
| 2645 | 12136 | 1.0 | 1.0 | 3.8 | 1.0 | 1.0 | 1.0 | 1.0 |
| 2646 | 17373 | 1.0 | 0.4 | 6.1 | 2.4 | 1.0 | 1.0 | 1.0 |
| 2647 | 18577 | 1.0 | 0.3 | 0.3 | 4.6 | 1.0 | 1.0 | 1.0 |
| 2648 | 3143 | 1.7 | 1.3 | 2.6 | 2.3 | 0.7 | 1.0 | 0.5 |
| 2649 | 17737 | 6.1 | 0.7 | 3.4 | 0.3 | 0.5 | 1.3 | 0.4 |
| 2650 | 20029 | 1.0 | 0.6 | 2.3 | 1.0 | 1.0 | 1.0 | 0.5 |
| 2651 | 18537 | 1.0 | 1.3 | 2.1 | 2.6 | 1.3 | 1.0 | 1.2 |
| 2652 | 10090 | 1.0 | 1.7 | 2.1 | 2.8 | 1.5 | 1.0 | 1.2 |
| 2653 | 12102 | 1.0 | 1.0 | 3.9 | 1.0 | 1.0 | 1.0 | 1.0 |
| 2654 | 8487 | 4.7 | 2.4 | 1.0 | 1.0 | 2.3 | 1.1 | 2.2 |
| 2655 | 9252 | 1.3 | 3.8 | 0.3 | 1.0 | 2.1 | 1.6 | 2.5 |
| 2656 | 25605 | 1.0 | 1.0 | 1.0 | 1.0 | 0.5 | 0.5 | 1.0 |
| 2657 | 29652 | 1.0 | 2.9 | 1.5 | 2.9 | 2.0 | 1.5 | 2.1 |
| 2658 | 10858 | 1.0 | 0.8 | 2.0 | 1.0 | 1.0 | 1.0 | 0.7 |
| 2659 | 1261 | 0.2 | 0.6 | 1.0 | 2.9 | 0.8 | 0.8 | 0.9 |
| 2660 | 4156 | 12.4 | 0.8 | 3.1 | 0.2 | 0.6 | 1.0 | 0.3 |
| 2661 | 3452 | 10.6 | 0.8 | 2.8 | 0.3 | 0.6 | 1.0 | 0.4 |
| 2662 | 2748 | 10.8 | 0.8 | 3.1 | 0.2 | 0.5 | 1.0 | 0.4 |
| 2663 | 2046 | 9.2 | 1.0 | 2.4 | 0.3 | 0.5 | 1.2 | 0.4 |
| 2664 | 2044 | 11.7 | 0.8 | 2.8 | 0.2 | 0.6 | 1.4 | 0.4 |
| 2665 | 1342 | 10.5 | 0.9 | 2.8 | 0.2 | 0.5 | 1.2 | 0.4 |
| 2666 | 1326 | 12.2 | 1.0 | 2.7 | 0.2 | 0.5 | 1.0 | 0.4 |
| 2667 | 9981 | 0.2 | 1.5 | 0.3 | 2.5 | 1.2 | 1.6 | 0.5 |
| 2668 | 27917 | 1.9 | 2.5 | 0.5 | 1.0 | 2.1 | 1.4 | 2.3 |
| 2669 | 8488 | 4.3 | 2.4 | 1.0 | 0.5 | 2.9 | 0.9 | 3.6 |
| 2670 | 22793 | 1.9 | 2.6 | 0.5 | 1.0 | 2.2 | 1.8 | 2.1 |
| 2671 | 26883 | 2.4 | 3.7 | 0.5 | 1.0 | 2.5 | 2.0 | 2.0 |
| 2672 | 11540 | 0.7 | 1.0 | 1.3 | 2.8 | 0.8 | 1.0 | 0.5 |
| 2673 | 17707 | 1.0 | 0.6 | 2.6 | 1.0 | 1.0 | 1.0 | 1.0 |
| 2674 | 20649 | 2.3 | 2.6 | 0.5 | 0.4 | 3.0 | 1.0 | 3.1 |
| 2675 | 24004 | 1.0 | 2.5 | 1.8 | 3.6 | 2.3 | 1.0 | 2.8 |
| 2676 | 11836 | 1.2 | 5.0 | 0.9 | 3.7 | 1.3 | 1.0 | 0.8 |
| 2677 | 24932 | 1.8 | 0.8 | 6.5 | 2.1 | 0.8 | 1.0 | 0.5 |
| 2678 | 19143 | 0.6 | 1.6 | 0.7 | 2.0 | 1.7 | 1.2 | 1.4 |
| 2679 | 26257 | 1.9 | 1.3 | 2.2 | 1.7 | 0.7 | 1.0 | 0.6 |
| 2680 | 21239 | 9.4 | 9.2 | 0.5 | 0.4 | 2.4 | 1.0 | 2.7 |
| 2681 | 16959 | 0.6 | 2.1 | 0.8 | 2.1 | 3.0 | 1.4 | 2.5 |
| 2682 | 2568 | 0.7 | 1.9 | 0.7 | 2.2 | 3.0 | 1.3 | 2.4 |
| 2683 | 25936 | 1.0 | 2.4 | 0.7 | 2.0 | 3.1 | 1.5 | 2.4 |
| 2684 | 23041 | 0.7 | 1.0 | 2.1 | 2.6 | 1.0 | 1.4 | 1.0 |
| 2685 | 9206 | 5.7 | 1.8 | 4.6 | 1.0 | 1.0 | 0.7 | 0.9 |
| 2686 | 25105 | 1.6 | 1.3 | 2.1 | 1.0 | 1.0 | 0.7 | 0.8 |
| 2687 | 24779 | 1.0 | 1.0 | 1.0 | 2.9 | 2.3 | 1.4 | 1.2 |
| 2688 | 22451 | 1.0 | 0.2 | 2.1 | 1.0 | 1.4 | 0.6 | 1.0 |
| 2689 | 22291 | 0.2 | 0.2 | 2.1 | 1.0 | 0.6 | 0.6 | 0.5 |
| 2690 | 21143 | 1.0 | 7.2 | 0.7 | 2.0 | 2.6 | 1.1 | 2.4 |
| 2691 | 24751 | 1.7 | 5.0 | 0.7 | 2.1 | 2.4 | 1.3 | 4.0 |
| 2692 | 24294 | 1.7 | 3.9 | 0.8 | 2.4 | 2.6 | 1.1 | 3.9 |
| 2693 | 24006 | 1.7 | 6.3 | 0.8 | 2.5 | 2.4 | 1.0 | 4.0 |
| 2694 | 25678 | 1.0 | 1.0 | 1.0 | 1.0 | 1.0 | 1.0 | 1.0 |
| 2695 | 22027 | 8.7 | 7.0 | 0.4 | 0.2 | 5.1 | 2.0 | 5.2 |
| 2696 | 29495 | 1.0 | 1.0 | 1.0 | 1.0 | 1.0 | 1.0 | 1.0 |
| 2697 | 24577 | 6.8 | 3.2 | 0.8 | 0.4 | 3.8 | 1.3 | 2.1 |
| 2698 | 23527 | 0.3 | 2.1 | 1.6 | 6.4 | 2.7 | 2.1 | 3.4 |
| 2699 | 17090 | 1.0 | 4.9 | 0.7 | 2.3 | 3.1 | 2.3 | 3.6 |
| 2700 | 25137 | 1.0 | 1.0 | 0.4 | 3.8 | 1.0 | 2.5 | 4.1 |
| 2701 | 23772 | 0.6 | 6.8 | 0.5 | 3.7 | 12.6 | 3.6 | 9.2 |

TABLE 19-continued

| SEQ ID NO. | SPOT ID | 2D T4-2/ 2D S1 | 3D T4-2/ 3D S1 | 3D S1/ 2D S1 | 3D T4-2/ 2D T4-2 | 3D T4-2/ EGFR Ab | 3D T4-2/ B1 Integrin Ab | 3D T4-2/ Tyr |
|---|---|---|---|---|---|---|---|---|
| 2702 | 1659 | 1.0 | 7.5 | 0.3 | 3.2 | 17.8 | 4.1 | 20.3 |
| 2703 | 8497 | 1.3 | 0.4 | 2.2 | 0.5 | 1.0 | 1.0 | 1.0 |
| 2704 | 25272 | 8.0 | 6.0 | 1.0 | 0.6 | 2.2 | 1.0 | 2.9 |
| 2705 | 21216 | 1.0 | 1.0 | 0.6 | 2.0 | 2.5 | 2.0 | 2.2 |
| 2706 | 11939 | 1.0 | 1.0 | 1.0 | 1.0 | 1.0 | 1.0 | 1.0 |
| 2707 | 9191 | 1.8 | 2.2 | 1.3 | 1.1 | 2.2 | 1.0 | 2.0 |
| 2708 | 3429 | 0.7 | 3.4 | 0.8 | 3.5 | 3.0 | 1.5 | 3.7 |
| 2709 | 2725 | 0.8 | 3.4 | 1.0 | 3.4 | 2.6 | 1.6 | 4.1 |
| 2710 | 19923 | 1.0 | 1.1 | 2.9 | 1.0 | 1.7 | 1.4 | 1.2 |
| 2711 | 20457 | 1.0 | 2.0 | 1.0 | 2.3 | 2.9 | 1.0 | 2.3 |
| 2712 | 24773 | 0.2 | 1.0 | 0.8 | 2.0 | 1.6 | 1.0 | 1.0 |
| 2713 | 24119 | 0.2 | 4.6 | 1.1 | 15.9 | 2.7 | 1.0 | 3.4 |
| 2714 | 3908 | 0.3 | 0.5 | 1.1 | 2.3 | 1.7 | 1.0 | 1.0 |
| 2715 | 8560 | 1.9 | 0.7 | 2.2 | 0.5 | 1.0 | 1.0 | 0.7 |
| 2716 | 24588 | 0.3 | 0.5 | 1.0 | 2.0 | 1.0 | 1.0 | 1.4 |
| 2717 | 4047 | 0.5 | 1.2 | 1.0 | 2.1 | 1.9 | 1.0 | 1.8 |
| 2718 | 28344 | 0.8 | 1.0 | 1.0 | 2.0 | 1.7 | 1.5 | 2.7 |
| 2719 | 27561 | 1.0 | 1.0 | 1.0 | 2.4 | 1.2 | 1.2 | 1.3 |
| 2720 | 3272 | 0.6 | 0.8 | 1.0 | 2.1 | 1.3 | 1.6 | 1.0 |
| 2721 | 26735 | 1.0 | 1.0 | 1.0 | 1.0 | 1.0 | 1.0 | 1.0 |
| 2722 | 24900 | 0.3 | 0.8 | 2.9 | 5.7 | 2.2 | 1.1 | 3.0 |
| 2723 | 9472 | 2.2 | 5.0 | 1.0 | 2.0 | 1.5 | 0.8 | 1.7 |
| 2724 | 9979 | 1.3 | 3.3 | 1.5 | 3.9 | 3.4 | 1.4 | 2.5 |
| 2725 | 21996 | 1.0 | 4.7 | 1.0 | 3.4 | 2.5 | 1.0 | 2.4 |
| 2726 | 22312 | 1.2 | 4.4 | 1.2 | 3.3 | 2.2 | 1.1 | 2.2 |
| 2727 | 11327 | 1.4 | 6.2 | 1.4 | 2.7 | 2.7 | 1.0 | 2.2 |
| 2728 | 18240 | 2.0 | 4.5 | 1.0 | 2.2 | 2.1 | 1.0 | 2.7 |
| 2729 | 21922 | 0.7 | 1.4 | 0.8 | 2.1 | 1.8 | 1.0 | 1.3 |
| 2730 | 22290 | 0.7 | 1.6 | 0.9 | 2.1 | 1.5 | 1.2 | 1.3 |
| 2731 | 10390 | 1.3 | 1.0 | 2.6 | 1.6 | 0.8 | 1.0 | 0.6 |
| 2732 | 2212 | 1.9 | 1.0 | 2.8 | 1.0 | 0.6 | 1.6 | 0.8 |
| 2733 | 20213 | 0.4 | 1.0 | 1.0 | 1.0 | 1.0 | 1.0 | 1.0 |
| 2734 | 24955 | 0.9 | 2.9 | 1.0 | 3.3 | 0.8 | 0.8 | 1.0 |
| 2735 | 19574 | 1.0 | 0.6 | 3.7 | 3.1 | 1.5 | 2.6 | 1.4 |
| 2736 | 19969 | 1.0 | 1.0 | 1.0 | 3.1 | 1.0 | 1.0 | 1.0 |
| 2737 | 8570 | 0.4 | 1.2 | 1.0 | 2.6 | 1.2 | 0.8 | 0.6 |
| 2738 | 18519 | 3.5 | 2.9 | 2.6 | 1.8 | 1.8 | 1.0 | 2.0 |
| 2739 | 9616 | 0.6 | 2.0 | 1.0 | 2.3 | 1.2 | 1.2 | 1.0 |
| 2740 | 22334 | 0.2 | 0.7 | 2.9 | 8.5 | 1.7 | 1.1 | 3.4 |
| 2741 | 17459 | 0.1 | 0.7 | 2.7 | 18.8 | 4.0 | 1.3 | 4.6 |
| 2742 | 25193 | 1.0 | 0.8 | 1.0 | 2.3 | 1.0 | 1.3 | 1.0 |
| 2743 | 25191 | 0.2 | 0.8 | 0.7 | 2.5 | 1.3 | 1.5 | 1.2 |
| 2744 | 9448 | 0.6 | 1.0 | 1.0 | 2.3 | 0.8 | 0.8 | 0.5 |
| 2745 | 25224 | 5.6 | 14.4 | 1.0 | 2.3 | 6.0 | 1.5 | 9.6 |
| 2746 | 20218 | 6.1 | 12.3 | 0.7 | 1.7 | 5.6 | 1.6 | 9.0 |
| 2747 | 3089 | 7.0 | 15.7 | 0.7 | 2.3 | 7.3 | 1.8 | 8.0 |
| 2748 | 23985 | 5.8 | 17.2 | 0.9 | 2.1 | 6.8 | 1.8 | 8.1 |
| 2749 | 19953 | 6.2 | 13.5 | 0.8 | 1.8 | 6.4 | 1.7 | 10.4 |
| 2750 | 11506 | 4.1 | 13.3 | 1.0 | 1.4 | 4.4 | 1.6 | 7.2 |
| 2751 | 22362 | 1.0 | 0.7 | 4.1 | 2.1 | 1.2 | 1.8 | 1.0 |
| 2752 | 25516 | 0.7 | 10.1 | 0.4 | 4.0 | 14.7 | 4.7 | 8.1 |
| 2753 | 25757 | 0.6 | 0.4 | 2.4 | 1.0 | 1.0 | 1.3 | 0.9 |
| 2754 | 24814 | 0.5 | 2.8 | 0.3 | 1.0 | 3.5 | 1.4 | 4.4 |
| 2755 | 21994 | 0.5 | 3.2 | 0.3 | 1.0 | 3.6 | 1.0 | 4.3 |
| 2756 | 27117 | 1.0 | 2.8 | 0.3 | 1.0 | 3.9 | 1.0 | 4.9 |
| 2757 | 24681 | 1.8 | 2.6 | 0.6 | 0.5 | 3.2 | 1.5 | 3.0 |
| 2758 | 22745 | 0.3 | 2.4 | 1.4 | 8.1 | 2.8 | 2.3 | 3.5 |
| 2759 | 24233 | 1.9 | 3.9 | 1.3 | 2.3 | 1.3 | 0.8 | 2.2 |
| 2760 | 2001 | 1.0 | 1.0 | 1.5 | 2.1 | 1.0 | 1.0 | 1.0 |
| 2761 | 21179 | 2.0 | 7.9 | 0.7 | 1.9 | 2.1 | 1.0 | 4.3 |
| 2762 | 17147 | 1.3 | 4.3 | 0.7 | 1.7 | 2.4 | 1.2 | 3.9 |
| 2763 | 8700 | 1.5 | 7.3 | 0.7 | 1.6 | 3.1 | 1.0 | 2.7 |
| 2764 | 21214 | 0.3 | 5.4 | 1.2 | 15.5 | 3.1 | 1.0 | 3.6 |
| 2765 | 26422 | 0.4 | 3.7 | 1.0 | 12.7 | 3.9 | 1.0 | 3.3 |
| 2766 | 22837 | 0.7 | 1.0 | 2.1 | 2.4 | 1.2 | 1.5 | 0.9 |
| 2767 | 21965 | 1.0 | 1.0 | 1.0 | 2.2 | 2.4 | 1.0 | 1.0 |
| 2768 | 25541 | 4.5 | 2.7 | 2.7 | 0.8 | 1.0 | 1.3 | 0.8 |
| 2769 | 18302 | 1.1 | 0.9 | 2.1 | 1.0 | 1.0 | 1.0 | 1.0 |
| 2770 | 24049 | 1.0 | 2.6 | 1.5 | 2.5 | 2.3 | 1.4 | 2.4 |
| 2771 | 26326 | 9.2 | 1.5 | 3.2 | 0.7 | 0.7 | 0.9 | 1.0 |
| 2772 | 2254 | 1.6 | 3.3 | 1.0 | 2.8 | 2.0 | 1.1 | 3.1 |
| 2773 | 10296 | 0.9 | 1.7 | 2.9 | 5.0 | 2.1 | 1.0 | 1.3 |
| 2774 | 20044 | 1.0 | 0.8 | 2.0 | 1.0 | 1.0 | 1.0 | 1.0 |
| 2775 | 28806 | 2.8 | 1.1 | 2.1 | 1.0 | 0.9 | 1.2 | 0.8 |
| 2776 | 17566 | 7.5 | 4.2 | 0.7 | 0.5 | 2.5 | 1.0 | 2.5 |

TABLE 19-continued

| SEQ ID NO. | SPOT ID | 2D T4-2/ 2D S1 | 3D T4-2/ 3D S1 | 3D S1/ 2D S1 | 3D T4-2/ 2D T4-2 | 3D T4-2/ EGFR Ab | 3D T4-2/ B1 Integrin Ab | 3D T4-2/ Tyr |
|---|---|---|---|---|---|---|---|---|
| 2777 | 19005 | 1.0 | 0.8 | 1.0 | 2.1 | 1.0 | 1.0 | 1.0 |
| 2778 | 3567 | 1.0 | 1.0 | 1.0 | 1.0 | 1.0 | 1.0 | 1.0 |
| 2779 | 21983 | 0.1 | 1.0 | 3.1 | 25.6 | 3.4 | 1.0 | 4.7 |
| 2780 | 458 | 1.0 | 2.1 | 0.6 | 1.0 | 1.6 | 2.1 | 2.3 |
| 2781 | 22331 | 0.6 | 2.1 | 0.4 | 1.0 | 2.2 | 1.0 | 2.8 |
| 2782 | 21411 | 0.7 | 1.5 | 1.0 | 2.5 | 1.0 | 1.0 | 1.0 |
| 2783 | 22972 | 1.0 | 2.2 | 0.5 | 1.0 | 2.2 | 1.4 | 2.4 |
| 2784 | 24533 | 1.0 | 2.5 | 1.0 | 2.0 | 2.0 | 2.7 | 3.2 |
| 2785 | 24853 | 1.0 | 2.6 | 2.1 | 2.1 | 2.4 | 1.3 | 2.1 |
| 2786 | 23753 | 0.7 | 1.5 | 1.3 | 2.1 | 2.0 | 1.7 | 2.3 |
| 2787 | 21502 | 0.3 | 4.8 | 1.0 | 10.8 | 2.6 | 1.0 | 2.9 |
| 2788 | 18180 | 0.3 | 0.8 | 0.8 | 2.4 | 0.9 | 1.4 | 0.7 |
| 2789 | 23918 | 0.7 | 2.3 | 0.4 | 1.0 | 2.4 | 1.2 | 3.5 |
| 2790 | 24144 | 1.0 | 1.0 | 1.0 | 1.0 | 1.0 | 1.6 | 1.0 |
| 2791 | 19996 | 1.5 | 2.5 | 0.7 | 1.2 | 2.1 | 0.9 | 2.5 |
| 2792 | 11528 | 1.0 | 1.0 | 1.0 | 2.1 | 1.0 | 1.0 | 1.0 |
| 2793 | 20506 | 2.2 | 0.9 | 3.2 | 0.8 | 1.3 | 1.6 | 1.0 |
| 2794 | 23833 | 1.0 | 0.5 | 2.1 | 1.0 | 1.0 | 1.0 | 0.7 |
| 2795 | 20042 | 3.8 | 1.6 | 2.3 | 0.8 | 1.0 | 1.0 | 1.0 |
| 2796 | 24977 | 1.0 | 1.0 | 2.1 | 1.0 | 2.3 | 1.4 | 1.4 |
| 2797 | 11646 | 1.0 | 1.0 | 0.8 | 1000.0 | 1.0 | 1.0 | 1.7 |
| 2798 | 24872 | 1.0 | 1.4 | 0.8 | 2.5 | 1.4 | 1.2 | 1.3 |
| 2799 | 10577 | 1.0 | 1.0 | 1.0 | 1.0 | 1.0 | 1.0 | 1.0 |
| 2800 | 21710 | 1.0 | 0.2 | 2.2 | 0.7 | 1.6 | 1.0 | 1.2 |
| 2801 | 18556 | 0.0 | 1.0 | 1.0 | 1.0 | 1.0 | 1.0 | 1.0 |
| 2802 | 29433 | 1.0 | 0.5 | 1.0 | 2.1 | 1.0 | 1.0 | 1.0 |
| 2803 | 29273 | 1.0 | 2.2 | 1.0 | 2.2 | 1.0 | 1.3 | 1.0 |
| 2804 | 28763 | 1.6 | 2.7 | 1.0 | 2.2 | 1.8 | 1.3 | 2.5 |
| 2805 | 27887 | 0.1 | 0.2 | 1.1 | 2.7 | 0.8 | 1.0 | 0.6 |
| 2806 | 27450 | 2.6 | 11.3 | 0.2 | 1.0 | 4.4 | 3.3 | 7.3 |
| 2807 | 27255 | 0.6 | 1.6 | 0.8 | 2.3 | 1.7 | 1.4 | 1.5 |
| 2808 | 27226 | 1.0 | 1.3 | 1.0 | 2.6 | 1.8 | 1.0 | 1.0 |
| 2809 | 26550 | 4.2 | 17.9 | 0.2 | 1.0 | 6.9 | 2.9 | 9.2 |
| 2810 | 26508 | 1.0 | 1.4 | 1.0 | 1.0 | 1.0 | 1.0 | 1.0 |
| 2811 | 26483 | 1.2 | 2.2 | 0.6 | 1.0 | 2.1 | 1.4 | 2.7 |
| 2812 | 26334 | 1.0 | 0.5 | 3.0 | 1.0 | 0.6 | 0.8 | 0.5 |
| 2813 | 26027 | 1.0 | 1.0 | 1.0 | 1.5 | 1.0 | 1.0 | 1.0 |
| 2814 | 25977 | 1.0 | 1.0 | 1.0 | 1.0 | 1.0 | 1.0 | 1.0 |
| 2815 | 25965 | 1.0 | 1.0 | 1.0 | 1.0 | 1.0 | 1.0 | 1.0 |
| 2816 | 25844 | 1.0 | 1.0 | 1.0 | 1.0 | 1.0 | 1.0 | 1.0 |
| 2817 | 25834 | 1000.0 | 1.0 | 1.0 | 1.0. | 0.4 | 1.0 | 1.0 |
| 2818 | 25816 | 1.0 | 1.0 | 1.0 | 1.0 | 1.0 | 1.0 | 1.0 |
| 2819 | 25746 | 1.0 | 1.0 | 1.0 | 1.0 | 1.0 | 1.0 | 1.0 |
| 2820 | 25742 | 1.0 | 1.0 | 1.0 | 1.0 | 0.5 | 1.0 | 1.0 |
| 2821 | 25741 | 1.0 | 1.0 | 1.0 | 1.0 | 1.0 | 1.0 | 1.0 |
| 2822 | 25712 | 1.0 | 1.0 | 1.0 | 1.0 | 1.0 | 1.0 | 1.0 |
| 2823 | 25642 | 1.0 | 1.0 | 1.0 | 1.0 | 1.0 | 1.0 | 1.0 |
| 2824 | 25621 | 0.6 | 0.8 | 2.1 | 2.0 | 1.3 | 1.2 | 1.0 |
| 2825 | 25614 | 1.0 | 1.0 | 1.0 | 1.0 | 1.0 | 1.0 | 1.0 |
| 2826 | 25603 | 1.0 | 1.0 | 1.0 | 1.0 | 1.0 | 1.0 | 1.0 |
| 2827 | 25556 | 1.8 | 0.7 | 1.0 | 0.8 | 1.0 | 1.0 | 1.0 |
| 2828 | 25555 | 1.0 | 2.9 | 1.0 | 1.0 | 1.5 | 1.3 | 1.0 |
| 2829 | 25540 | 1.0 | 1.0 | 1.0 | 1.2 | 1.0 | 1.0 | 1.0 |
| 2830 | 23576 | 0.0 | 1.0 | 1.0 | 1.0 | 1.0 | 1.5 | 1.4 |
| 2831 | 22566 | 1.0 | 1.0 | 1.0 | 1.0 | 1.0 | 1.3 | 1.0 |
| 2832 | 9036 | 1.9 | 3.8 | 0.6 | 1.8 | 2.6 | 1.3 | 3.1 |
| 2833 | 4164 | 1.0 | 1.0 | 2.2 | 1.0 | 1.5 | 1.0 | 0.9 |
| 2834 | 4146 | 0.8 | 3.7 | 0.9 | 4.4 | 3.3 | 1.0 | 4.3 |
| 2835 | 4091 | 1.0 | 1.0 | 1.0 | 2.5 | 1.7 | 1.0 | 0.9 |
| 2836 | 4072 | 1.0 | 1.0 | 2.1 | 1.0 | 5.9 | 2.0 | 5.1 |
| 2837 | 4022 | 3.5 | 4.5 | 0.8 | 1.0 | 3.0 | 1.0 | 3.2 |
| 2838 | 3965 | 1.9 | 5.6 | 0.4 | 1.0 | 5.5 | 2.3 | 4.1 |
| 2839 | 3954 | 1.0 | 2.7 | 1.3 | 3.6 | 2.8 | 1.9 | 2.6 |
| 2840 | 3872 | 1.0 | 3.2 | 1.3 | 2.8 | 4.0 | 1.8 | 3.9 |
| 2841 | 3869 | 1.0 | 1.0 | 5.8 | 3.8 | 1.0 | 0.7 | 0.6 |
| 2842 | 3838 | 1.0 | 1.6 | 1.2 | 2.0 | 2.6 | 1.7 | 1.9 |
| 2843 | 3806 | 0.6 | 2.6 | 0.9 | 3.7 | 3.0 | 1.0 | 3.4 |
| 2844 | 3798 | 10.2 | 0.9 | 2.9 | 0.3 | 0.7 | 1.0 | 0.4 |
| 2845 | 3792 | 1.0 | 1.0 | 1.0 | 2.7 | 2.9 | 1.0 | 2.5 |
| 2846 | 3788 | 1.7 | 5.4 | 1.2 | 3.4 | 2.5 | 1.3 | 2.7 |
| 2847 | 3767 | 1.1 | 2.2 | 0.7 | 1.7 | 2.5 | 1.0 | 2.5 |
| 2848 | 3458 | 1.2 | 3.3 | 0.7 | 2.0 | 2.6 | 1.0 | 2.2 |
| 2849 | 3251 | 0.4 | 0.5 | 1.4 | 2.7 | 1.4 | 1.0 | 1.0 |
| 2850 | 3194 | 1.0 | 2.3 | 1.3 | 3.1 | 2.2 | 1.3 | 3.2 |
| 2851 | 3102 | 0.5 | 3.2 | 1.0 | 4.8 | 2.9 | 1.0 | 2.3 |

TABLE 19-continued

| SEQ ID NO. | SPOT ID | 2D T4-2/ 2D S1 | 3D T4-2/ 3D S1 | 3D S1/ 2D S1 | 3D T4-2/ 2D T4-2 | 3D T4-2/ EGFR Ab | 3D T4-2/ B1 Integrin Ab | 3D T4-2/ Tyr |
|---|---|---|---|---|---|---|---|---|
| 2852 | 3094 | 11.5 | 0.8 | 2.7 | 0.3 | 0.6 | 1.0 | 0.4 |
| 2853 | 2671 | 0.8 | 1.6 | 1.0 | 2.2 | 2.8 | 1.9 | 1.0 |
| 2854 | 2634 | 0.9 | 2.8 | 0.4 | 1.0 | 3.8 | 1.7 | 4.0 |
| 2855 | 2567 | 4.6 | 3.3 | 0.8 | 0.6 | 2.6 | 1.0 | 3.3 |
| 2856 | 2317 | 1.0 | 1.0 | 2.4 | 1.0 | 1.0 | 1.0 | 1.1 |
| 2857 | 1958 | 0.3 | 0.6 | 1.0 | 2.6 | 0.9 | 0.8 | 0.9 |
| 2858 | 1680 | 0.3 | 4.7 | 1.0 | 17.7 | 2.7 | 1.0 | 4.5 |
| 2859 | 1625 | 2.2 | 7.8 | 0.5 | 1.8 | 3.1 | 1.7 | 3.4 |
| 2860 | 1445 | 0.2 | 0.6 | 1.0 | 2.7 | 0.8 | 0.9 | 0.9 |
| 2861 | 1320 | 4.9 | 1.0 | 2.4 | 0.4 | 0.6 | 1.2 | 0.5 |
| 2862 | 974 | 0.6 | 3.1 | 1.1 | 3.2 | 2.4 | 1.4 | 3.7 |
| 2863 | 726 | 1.0 | 1.0 | 1.0 | 1.0 | 1.0 | 1.0 | 1.0 |
| 2864 | 718 | 0.4 | 2.6 | 0.5 | 2.7 | 1.6 | 1.0 | 1.0 |
| 2865 | 703 | 1.0 | 4.1 | 1.0 | 2.4 | 1.6 | 1.0 | 1.7 |
| 2866 | 652 | 2.8 | 4.4 | 1.6 | 2.3 | 1.0 | 1.6 | 1.0 |
| 2867 | 630 | 6.9 | 1.0 | 2.2 | 0.3 | 0.6 | 1.0 | 0.5 |
| 2868 | 593 | 1.0 | 4.3 | 1.0 | 2.3 | 1.0 | 1.0 | 1.0 |
| 2869 | 532 | 1.3 | 4.7 | 1.0 | 2.4 | 2.6 | 2.2 | 4.0 |
| 2870 | 272 | 0.7 | 2.7 | 0.9 | 3.1 | 2.4 | 1.3 | 4.3 |
| 2871 | 256 | 0.6 | 3.2 | 0.5 | 1.9 | 2.8 | 1.0 | 3.4 |
| 2872 | 57 | 0.5 | 1.4 | 1.0 | 2.3 | 0.9 | 1.0 | 0.7 |

TABLE 20

| SEQ ID NO | SPOT ID |
|---|---|
| 2506 | 10594 |
| 2507 | 21851 |
| 2508 | 20990 |
| 2509 | 18641 |
| 2510 | 19037 |
| 2511 | 398 |
| 2512 | 18773 |
| 2513 | 3583 |
| 2514 | 3418 |
| 2515 | 145306 |
| 2516 | 3418 |
| 2517 | 3418 |
| 2518 | 18985 |
| 2519 | 17229 |
| 2520 | 25930 |
| 2521 | 25930 |
| 2522 | 20701 |
| 2523 | 20346 |
| 2524 | 20346 |
| 2525 | 21247 |
| 2526 | 21247 |
| 2527 | 23062 |
| 2528 | 25666 |
| 2529 | 25666 |
| 2530 | 19001 |
| 2531 | 10897 |
| 2532 | 10897 |
| 2533 | 10897 |
| 2534 | 1960 |
| 2535 | 146262 |
| 2536 | 26381 |
| 2537 | 26381 |
| 2538 | 26719 |
| 2539 | 26719 |
| 2540 | 27152 |
| 2541 | 10926 |
| 2542 | 28980 |
| 2543 | 1236 |
| 2544 | 29350 |
| 2545 | 29350 |
| 2546 | 26242 |
| 2547 | 4098 |
| 2548 | 145253 |
| 2549 | 4098 |
| 2550 | 17432 |
| 2551 | 17432 |
| 2552 | 1785 |
| 2553 | 1785 |
| 2554 | 1785 |
| 2555 | 28856 |
| 2556 | 28856 |
| 2557 | 18791 |
| 2558 | 18791 |
| 2559 | 22950 |
| 2560 | 22950 |
| 2561 | 1882 |
| 2562 | 23886 |
| 2563 | 24995 |
| 2564 | 24995 |
| 2565 | 24477 |
| 2566 | 21681 |
| 2567 | 21681 |
| 2568 | 9557 |
| 2569 | 9557 |
| 2570 | 22033 |
| 2571 | 873 |
| 2572 | 17144 |
| 2573 | 26970 |
| 2574 | 26970 |
| 2575 | 21402 |
| 2576 | 27074 |
| 2577 | 27074 |
| 2578 | 10963 |
| 2579 | 10963 |
| 2580 | 29525 |
| 2581 | 29525 |
| 2582 | 25514 |
| 2583 | 25514 |
| 2584 | 26612 |
| 2585 | 26612 |
| 2586 | 24600 |
| 2587 | 9741 |
| 2588 | 9741 |
| 2589 | 9741 |
| 2590 | 23689 |
| 2591 | 23689 |
| 2592 | 22352 |
| 2593 | 23806 |
| 2594 | 12285 |
| 2595 | 27638 |

TABLE 20-continued

| SEQ ID NO | SPOT ID |
|---|---|
| 2596 | 27638 |
| 2597 | 9663 |
| 2598 | 9663 |
| 2599 | 26850 |
| 2600 | 10204 |
| 2601 | 10204 |
| 2602 | 10204 |
| 2603 | 25922 |
| 2604 | 25922 |
| 2605 | 26347 |
| 2606 | 26347 |
| 2607 | 20361 |
| 2608 | 20361 |
| 2609 | 28672 |
| 2610 | 28672 |
| 2611 | 25520 |
| 2612 | 25520 |
| 2613 | 1723 |
| 2614 | 1723 |
| 2615 | 28863 |
| 2616 | 25526 |
| 2617 | 25526 |
| 2618 | 27936 |
| 2619 | 27936 |
| 2620 | 26851 |
| 2621 | 25107 |
| 2622 | 25107 |
| 2623 | 25107 |
| 2624 | 24912 |
| 2625 | 24912 |
| 2626 | 25169 |
| 2627 | 25600 |
| 2628 | 25600 |
| 2629 | 28706 |
| 2630 | 28706 |
| 2631 | 26377 |
| 2632 | 26377 |
| 2633 | 19460 |
| 2634 | 25243 |
| 2635 | 20018 |
| 2636 | 20018 |
| 2637 | 918 |
| 2638 | 25027 |
| 2639 | 29089 |
| 2640 | 29089 |
| 2641 | 9141 |
| 2642 | 9141 |
| 2643 | 9141 |
| 2644 | 12005 |
| 2645 | 12148 |
| 2646 | 12148 |
| 2647 | 17394 |
| 2648 | 27017 |
| 2649 | 27017 |
| 2650 | 25809 |
| 2651 | 8719 |
| 2652 | 8719 |
| 2653 | 21030 |
| 2654 | 21030 |
| 2655 | 11436 |
| 2656 | 11436 |
| 2657 | 10374 |
| 2658 | 10374 |
| 2659 | 25861 |
| 2660 | 25861 |
| 2661 | 3317 |
| 2662 | 3317 |
| 2663 | 8743 |
| 2664 | 26240 |
| 2665 | 26240 |
| 2666 | 28562 |
| 2667 | 16877 |
| 2668 | 25955 |
| 2669 | 26308 |
| 2670 | 26308 |
| 2671 | 4140 |
| 2672 | 3436 |
| 2673 | 25612 |
| 2674 | 25612 |
| 2675 | 12257 |
| 2676 | 12257 |
| 2677 | 9111 |
| 2678 | 9111 |
| 2679 | 17620 |
| 2680 | 26025 |
| 2681 | 26025 |
| 2682 | 19271 |
| 2683 | 4151 |
| 2684 | 4151 |
| 2685 | 26569 |
| 2686 | 26569 |
| 2687 | 10344 |
| 2688 | 10344 |
| 2689 | 10344 |
| 2690 | 832 |
| 2691 | 832 |
| 2692 | 12071 |
| 2693 | 12071 |
| 2694 | 12271 |
| 2695 | 11433 |
| 2696 | 20917 |
| 2697 | 25810 |
| 2698 | 12039 |
| 2699 | 12039 |
| 2700 | 25499 |
| 2701 | 25499 |
| 2702 | 25557 |
| 2703 | 25557 |
| 2704 | 9917 |
| 2705 | 19505 |
| 2706 | 17491 |
| 2707 | 10683 |
| 2708 | 10683 |
| 2709 | 1936 |
| 2710 | 828 |
| 2711 | 9558 |
| 2712 | 9558 |
| 2713 | 20164 |
| 2714 | 969 |
| 2715 | 969 |
| 2716 | 9910 |
| 2717 | 2427 |
| 2718 | 19990 |
| 2719 | 20605 |
| 2720 | 20605 |
| 2721 | 10650 |
| 2722 | 10650 |
| 2723 | 25963 |
| 2724 | 25963 |
| 2725 | 25562 |
| 2726 | 25562 |
| 2727 | 3429 |
| 2728 | 2725 |
| 2729 | 19923 |
| 2730 | 20457 |
| 2731 | 20457 |
| 2732 | 24773 |
| 2733 | 24119 |
| 2734 | 3908 |
| 2735 | 3908 |
| 2736 | 8560 |
| 2737 | 8560 |
| 2738 | 9377 |
| 2739 | 9377 |
| 2740 | 17618 |
| 2741 | 12136 |
| 2742 | 17373 |
| 2743 | 18577 |
| 2744 | 18577 |
| 2745 | 3143 |
| 2746 | 17737 |
| 2747 | 17737 |
| 2748 | 20029 |
| 2749 | 20029 |

TABLE 20-continued

| SEQ ID NO | SPOT ID |
|---|---|
| 2750 | 18537 |
| 2751 | 18537 |
| 2752 | 12102 |
| 2753 | 12102 |
| 2754 | 8487 |
| 2755 | 9252 |
| 2756 | 9252 |
| 2757 | 25605 |
| 2758 | 25605 |
| 2759 | 29652 |
| 2760 | 10858 |
| 2761 | 1261 |
| 2762 | 4156 |
| 2763 | 4156 |
| 2764 | 3452 |
| 2765 | 3452 |
| 2766 | 2748 |
| 2767 | 2046 |
| 2768 | 2046 |
| 2769 | 2044 |
| 2770 | 2044 |
| 2771 | 1342 |
| 2772 | 1342 |
| 2773 | 1326 |
| 2774 | 1326 |
| 2775 | 9981 |
| 2776 | 9981 |
| 2777 | 27917 |
| 2778 | 8488 |
| 2779 | 22793 |
| 2780 | 22793 |
| 2781 | 26883 |
| 2782 | 26883 |
| 2783 | 11540 |
| 2784 | 17707 |
| 2785 | 20649 |
| 2786 | 20649 |
| 2787 | 24004 |
| 2788 | 24004 |
| 2789 | 11836 |
| 2790 | 11836 |
| 2791 | 11836 |
| 2792 | 24932 |
| 2793 | 19143 |
| 2794 | 19143 |
| 2795 | 26257 |
| 2796 | 26257 |
| 2797 | 21239 |
| 2798 | 21239 |
| 2799 | 16959 |
| 2800 | 2568 |
| 2801 | 25936 |
| 2802 | 25936 |
| 2803 | 23041 |
| 2804 | 9206 |
| 2805 | 25105 |
| 2806 | 25105 |
| 2807 | 24779 |
| 2808 | 22451 |
| 2809 | 22451 |
| 2810 | 22291 |
| 2811 | 22291 |
| 2812 | 21143 |
| 2813 | 24751 |
| 2814 | 24751 |
| 2815 | 24294 |
| 2816 | 24294 |
| 2817 | 24006 |
| 2818 | 24006 |
| 2819 | 25678 |
| 2820 | 25678 |
| 2821 | 22027 |
| 2822 | 29495 |
| 2823 | 29495 |
| 2824 | 24577 |
| 2825 | 24577 |
| 2826 | 24577 |
| 2827 | 23527 |
| 2828 | 17090 |
| 2829 | 25137 |
| 2830 | 23772 |
| 2831 | 1659 |
| 2832 | 8497 |
| 2833 | 25272 |
| 2834 | 21216 |
| 2835 | 21216 |
| 2836 | 21216 |
| 2837 | 11939 |
| 2838 | 11939 |
| 2839 | 11939 |
| 2840 | 9191 |
| 2841 | 3429 |
| 2842 | 24588 |
| 2843 | 4047 |
| 2844 | 28344 |
| 2845 | 28344 |
| 2846 | 27561 |
| 2847 | 3272 |
| 2848 | 26735 |
| 2849 | 26735 |
| 2850 | 24900 |
| 2851 | 24900 |
| 2852 | 9472 |
| 2853 | 9472 |
| 2854 | 9979 |
| 2855 | 21996 |
| 2856 | 22312 |
| 2857 | 11327 |
| 2858 | 18240 |
| 2859 | 18240 |
| 2860 | 21922 |
| 2861 | 21922 |
| 2862 | 22290 |
| 2863 | 10390 |
| 2864 | 10390 |
| 2865 | 2212 |
| 2866 | 20213 |
| 2867 | 20213 |
| 2868 | 24955 |
| 2869 | 19574 |
| 2870 | 19969 |
| 2871 | 8570 |
| 2872 | 18519 |
| 2506 | 9616 |
| 2507 | 9616 |
| 2508 | 17459 |
| 2509 | 17459 |
| 2510 | 25193 |
| 2511 | 25193 |
| 2512 | 25193 |
| 2513 | 25191 |
| 2514 | 22566 |
| 2515 | 4164 |
| 2516 | 4146 |
| 2517 | 4072 |
| 2518 | 4022 |
| 2519 | 3954 |
| 2520 | 3838 |
| 2521 | 3806 |
| 2522 | 3798 |
| 2523 | 3792 |
| 2524 | 3788 |
| 2525 | 3458 |
| 2526 | 3194 |
| 2527 | 3102 |
| 2528 | 25191 |
| 2529 | 25191 |
| 2530 | 9448 |
| 2531 | 9448 |
| 2532 | 25224 |
| 2533 | 20218 |
| 2534 | 3089 |
| 2535 | 3089 |
| 2536 | 19953 |

TABLE 20-continued

| SEQ ID NO | SPOT ID |
|---|---|
| 2537 | 19953 |
| 2538 | 22362 |
| 2539 | 25516 |
| 2540 | 25516 |
| 2541 | 25757 |
| 2542 | 24814 |
| 2543 | 21994 |
| 2544 | 27117 |
| 2545 | 22745 |
| 2546 | 24233 |
| 2547 | 2001 |
| 2548 | 2001 |
| 2549 | 2001 |
| 2550 | 17147 |
| 2551 | 21214 |
| 2552 | 21214 |
| 2553 | 21214 |
| 2554 | 26422 |
| 2555 | 21965 |
| 2556 | 25541 |
| 2557 | 25541 |
| 2558 | 18302 |
| 2559 | 18302 |
| 2560 | 24049 |
| 2561 | 24049 |
| 2562 | 26326 |
| 2563 | 26326 |
| 2564 | 2254 |
| 2565 | 162502 |
| 2566 | 10296 |
| 2567 | 20044 |
| 2568 | 28806 |
| 2569 | 17566 |
| 2570 | 17566 |
| 2571 | 19005 |
| 2572 | 3567 |
| 2573 | 159223 |
| 2574 | 3567 |
| 2575 | 3567 |
| 2576 | 458 |
| 2577 | 21411 |
| 2578 | 22972 |
| 2579 | 24853 |
| 2580 | 21502 |
| 2581 | 18180 |
| 2582 | 23918 |
| 2583 | 24144 |
| 2584 | 19996 |
| 2585 | 11528 |
| 2586 | 20506 |
| 2587 | 20506 |
| 2588 | 23833 |
| 2589 | 20042 |
| 2590 | 20042 |
| 2591 | 11646 |
| 2592 | 10577 |
| 2593 | 10577 |
| 2594 | 18556 |
| 2595 | 29433 |
| 2596 | 28763 |
| 2597 | 27450 |
| 2598 | 27450 |
| 2599 | 27255 |
| 2600 | 26550 |
| 2601 | 26550 |
| 2602 | 26508 |
| 2603 | 26334 |
| 2604 | 26334 |
| 2605 | 26027 |
| 2606 | 26027 |
| 2607 | 25977 |
| 2608 | 25977 |
| 2609 | 25965 |
| 2610 | 25965 |
| 2611 | 25844 |
| 2612 | 25844 |
| 2613 | 25834 |
| 2614 | 25816 |
| 2615 | 25746 |
| 2616 | 25712 |
| 2617 | 25621 |
| 2618 | 25621 |
| 2619 | 25614 |
| 2620 | 25614 |
| 2621 | 25603 |
| 2622 | 25603 |
| 2623 | 25556 |
| 2624 | 25556 |
| 2625 | 25555 |
| 2626 | 25555 |
| 2627 | 3094 |
| 2628 | 2567 |
| 2629 | 1958 |
| 2630 | 1680 |
| 2631 | 1445 |
| 2632 | 1320 |
| 2633 | 974 |
| 2634 | 652 |
| 2635 | 630 |
| 2636 | 593 |
| 2637 | 256 |

Example 41

Cyclin G Associated Kinase (GAK)

A gene or product thereof called cyclin G associated kinase, or GAK, was identified as being overexpressed in 3D T4-2 cultures relative to both 3D S1 cultures (ratio: 7.9296) and 2D T4-2 cultures (ratio: 34.6682) (Sample ID RG:1056692:10012:C11, Spot ID 19990). GAK corresponds to Genbank Accession number XM_003450.

Example 42

Antisense Regulation of GAK Expression

Additional functional information on GAK was generated using antisense knockout technology. A number of different oligonucleotides complementary to GAK mRNA were designed (AS) with corresponding controls (RC): GGAAT-CACCGCTTTGCCATCTTCAA (SEQ ID NO:3005; CHIR159-1AS, gak:P1868AS), AACTTCTAC-CGTTTCGCCACTAAGG (SEQ ID NO:3006; CHIR159-1RC, gak:P1868RC); GACCGTGTACTGCGTGTCGT-GCG (SEQ ID NO:3007; CHIR159-7AS, gak:P0839AS) and GCGTGCTGTGCGTCATGTGCCAG (SEQ ID NO: 3008; CHIR159-7RC, gak:P0839RC), and tested for their ability to suppress expression of GAK in human malignant colorectal carcinoma SW620 cells, human breast cancer MDA231 cells, and human breast cancer T4-2 cells. For each transfection mixture, a carrier molecule, preferably a lipitoid or cholesteroid, was prepared to a working concentration of 0.5 mM in water, sonicated to yield a uniform solution, and filtered through a 0.45 µm PVDF membrane. The antisense or control oligonucleotide was then prepared to a working concentration of 100 µM in sterile Millipore water. The oligonucleotide was further diluted in OptiMEM™ (Gibco/BRL), in a microfuge tube, to 2 µM, or approximately 20 µg oligo/ml of OptiMEM™. In a separate microfuge tube, lipitoid or cholesteroid, typically in the amount of about 1.5-2 nmol lipitoid/µg antisense oligonucleotide, was diluted into the same volume of OptiMEM™ used to dilute the oligonucleotide. The diluted antisense oligonucleotide was immediately added to the diluted lipitoid and mixed by pipetting up and down. Oligonucleotide was added to the cells to a final concentration of 300 nM.

The level of target mRNA (GAK) in the transfected cells was quantitated in the cancer cell lines using the methods using primers CHIR159_2896 (GCCGTCTTCAGGCAA-CAACTCCCA; SEQ ID NO: 3009; forward) and CHIR159_3089 (TGCTGGACGAGGCTGTCATCTTGC; SEQ ID NO: 3010; reverse). RNA was extracted as above according to manufacturer's directions.

Quantitative PCR (qPCR) was performed by first isolating the RNA from the above mentioned tissue/cells using a Qiagen RNeasy mini prep kit. A total of 0.5 micrograms of RNA was used to generate a first strand cDNA using Stratagene MuLV Reverse Transcriptase, using recommended concentrations of buffer, enzyme, and Rnasin. Concentrations and volumes of dNTP, and oligo dT, or random hexamers were lower than recommended to reduce the level of background primer dimerization in the qPCR.

The cDNA is then used for qPCR to determine the levels of expression of GAK using the GeneAmp 7000 by ABI as recommended by the manufacturer. Primers for actin were also used in order to normalized the values, and eliminate possible variations in cDNA template concentrations, pipetting error, etc.

For each 20 µl reaction, extracted RNA (generally 0.2-1 µg total) was placed into a sterile 0.5 or 1.5 ml microcentrifuge tube, and water was added to a total volume of 12.5 µl. To each tube was added 7.5 µl of a buffer/enzyme mixture, prepared by mixing (in the order listed) 2.5 µl $H_2O$, 2.0 µl 10× reaction buffer, 10 µl oligo dT (20 pmol), 1.0 µl dNTP mix (10 mM each), 0.5 µl RNAsin® (20 u) (Ambion, Inc., Hialeah, Fla.), and 0.5 µl MMLV reverse transcriptase (50 u) (Ambion, Inc.). The contents were mixed by pipetting up and down, and the reaction mixture was incubated at 42° C. for 1 hour. The contents of each tube were centrifuged prior to amplification.

An amplification mixture was prepared by mixing in the following order: 1× PCR buffer II, 3 mM $MgCl_2$, 140 µM each dNTP, 0.175 pmol each oligo, 1:50,000 dil of SYBR® Green, 0.25 mg/ml BSA, 1 unit Taq polymerase, and $H_2O$ to 20 µl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 µl aliquot of amplification mixture, 2 µl of template RT was added, and amplification was carried out according to standard protocols.

Table 21 shows that the antisense oligonucleotides described above reduced expression of GAK mRNA as compared to controls in all three cell lines. GAK mRNA reduction ranged from about 50% to about 90%, as compared to cells transfected with reverse (i.e. sense) control oligonucleotides.

TABLE 21 antisense regulation of GAK mRNA

| Oligo | Cell Line | Gene Message | Actin Message | Ratio | Percent KO |
|---|---|---|---|---|---|
| CHIR159-1AS | SW620 | 0.0923 | 0.669 | 0.138 | 90.7 |
| CHIR159-1RC | SW620 | 1.01 | 0.680 | 1.49 | |
| CHIR159-7AS | SW620 | 0.0555 | 0.678 | 0.082 | 85.4 |
| CHIR159-7RC | SW620 | 0.335 | 0.598 | 0.560 | |
| CHIR159-1AS | MDA231 | 0.358 | 0.687 | 0.521 | 59.3 |
| CHIR159-1RC | MDA231 | 1.00 | 0.784 | 1.28 | |
| CHIR159-7AS | MDA231 | 0.262 | 0.674 | 0.389 | 69.4 |
| CHIR159-7RC | MDA231 | 0.840 | 0.659 | 1.27 | |
| CHIR159-1AS | T4-2 | 0.307 | 0.707 | 0.434 | 72.9 |
| CHIR159-1RC | T4-2 | 1.23 | 0.770 | 1.60 | |
| CHIR159-7AS | T4-2 | 0.214 | 0.649 | 0.330 | 49.8 |
| CHIR159-7RC | T4-2 | 0.506 | 0.770 | 0.657 | |

Figure 38:
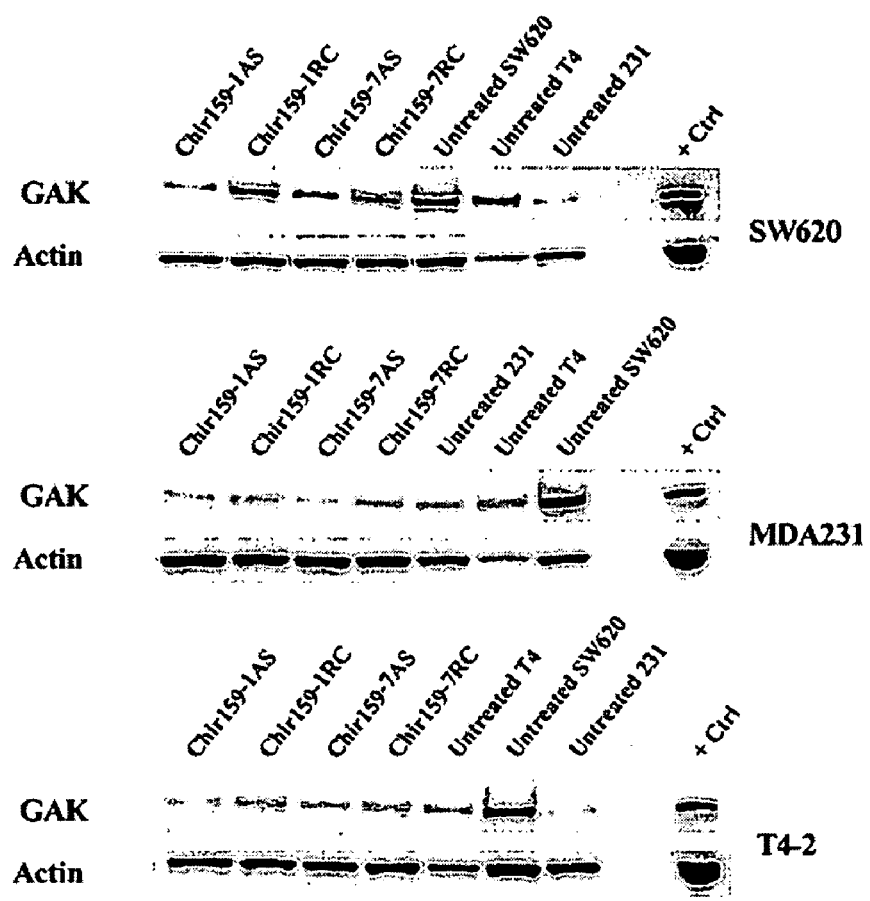
FIG. 38 is three panels of autoradiographs showing expression of GAK polypeptide in different cell lines.

Reduction of GAK protein by antisense polynucleotides in SW620, MDA231 and T4-2 was confirmed using an antibody that specifically recognizes GAK. FIG. 38 shows a western (i.e. protein) blot of protein extracts of the above cell lines decorated with anti-GAK antibodies. GAK protein expression is reduced in cell lines receiving GAK antisense oligonucleotides.

Example 43

Role of GAK in Anchorage Independent Cell Growth

The effect of GAK gene expression upon anchorage-independent cell growth of SW620 and MBA-231 cells was measured by colony formation in soft agar. Soft agar assays were performed by first coating a non-tissue culture treated plate with PolyHEMA to prevent cells from attaching to the plate. Non-transfected cells were harvested using 0.05% trypsin and washing twice in media. The cells are counted using a hemacytometer and resuspended to $10^4$ per ml in media. 50 µl aliquots are placed in poly-HEMA coated 96-well plates and transfected. For each transfection mixture, a carrier molecule, preferably a lipitoid or cholesteroid, was prepared to a working concentration of 0.5 mM in water, sonicated to yield a uniform solution, and filtered through a 0.45 µm PVDF membrane. The antisense or control oligonucleotide was then prepared to a working concentration of 100 µM in sterile Millipore water. The oligonucleotide was further diluted in OptiMEM™ (Gibco/BRL), in a microfuge tube, to 2 µM, or approximately 20 µg oligo/ml of OptiMEM™. In a separate microfuge tube, lipitoid or cholesteroid, typically in the amount of about 1.5-2 nmol lipitoid/µg antisense oligonucleotide, was diluted into the same volume of OptiMEM™ used to dilute the oligonucleotide. The diluted antisense oligonucleotide was immediately added to the diluted lipitoid and mixed by pipetting up and down. Oligonucleotide was added to the cells to a final concentration of 300 nM. Following transfection (~30 minutes), 3% GTG agarose is added to the cells for a final concentration of 0.35% agarose. After the cell layer agar solidifies, 100 µl of media is dribbled on top of each well. Colonies form in 7 days. For a read-out of growth, 20 µl of Alamar Blue is added to each well and the plate is shaken for 15 minutes. Fluorescence readings (530 nm excitation 590 nm emission) are taken after incubation for 6-24 hours.

The data presented in Table 22 shows that the application of GAK antisense oligonucleotides to SW620 and MDA 231 cells results in inhibition of colony formation and shows that GAK plays a role in production anchorage-independent cell growth. Table 22 shows the average fluorescence reading for several experiments. The standard deviation (St. Dev) of the fluorescence reading and coefficient of variation (% CV) is also shown.

TABLE 22

GAK and anchorage-independent cell growth.

| Oligo | Cell Line | Average | St. Dev | % CV |
|---|---|---|---|---|
| Blank | SW620 | 12868.17 | 208.78 | 1.78 |
| Untreated | SW620 | 31075.17 | 1944.36 | 7.66 |
| Pos Control | SW620 | 5717.17 | 1108.71 | 23.75 |
| Neg Control | SW620 | 7576.17 | 465.95 | 7.63 |
| Chir159-1AS | SW620 | 9701.5 | 2281.36 | 28.8 |
| Chir159-1RC | SW620 | 17765.5 | 1958.45 | 13.5 |
| Blank | MDA231 | 12726.83 | 232.45 | 2 |
| Untreated | MDA231 | 87272.17 | 0 | 0 |
| Pos Control | MDA231 | 10645.17 | 1591.08 | 18.31 |
| Neg Control | MDA231 | 24159.5 | 2850.58 | 14.45 |
| Chir159-1AS | MDA231 | 8613.5 | 4852.76 | 69 |
| Chir159-1RC | MDA231 | 17859.17 | 1535.55 | 10.53 |

Example 44

DKFZp566I133 (DKFZ)

Several previously uncharacterized genes were identified as being induced in these experiments. One such gene was represented by two spots, Spot ID Nos 22793 and 26883 (gene assignment DKFZp566I133). This gene was expressed at a ratio of about 2.2 in two 2-dimensional (2D) T4-2 vs. 2D S1 experiments, and also at a ratio of about 2 when 3-dimensional (3D) T4-2 cells were compared to the various tumor reversion cultures. However, the ratio of expression increased to an average of 3.2 when 3-dimensional (3D) T4-2 cultures were compared to 2D S1 cultures. In contrast, there was essentially no difference in expression levels when 3D S1 cultures were compared to 2D S1 cultures, suggesting that expression of this gene is specifically elevated in the tumorigenic cell line T4-2, and even further elevated when the tumorigenic cell line is grown in three dimensional cultures (see Table 23).

TABLE 23

| Spot ID | 2D T4-2/ 2D S1 | 3D T42/ 3D S1 | 3D S1/ 2D S1 | 3D T4-2/ 2D T4-2 | 3D T4-2/ EGFRAb | 3D T4-2/B1 integrin Ab | 3D T4-2/ Tyr |
|---|---|---|---|---|---|---|---|
| 22893 | 1.90387 | 2.64711 | 0.522161 | 1 | 2.17956 | 1.75287 | 2.055538 |
| 26883 | 2.43428 | 3.74613 | 0.524466 | 1 | 2.467573 | 2.029468 | 2.002817 |

These array data were confirmed by qPCR using the methods described above and the gene specific PCR primers CHIR180_1207 ACAGGGAGAAAACTGGTTGTCCTGG (SEQ ID NO:3011; Forward) and CHIR180_1403 AAGGCAGAACCCATCCACTCCAA (SEQ ID NO:3012; Reverse). Independent cultures were used for these experiments, and data was normalized to B-catenin. These data are shown in Table 24.

TABLE 24

| 2D S1 | 2D T4-2 | 3D S1 | 3D T4-2 | 3D EGFRAb | 3D B1 Integrin Ab | 3D Tyr |
|---|---|---|---|---|---|---|
| 0.165 | 0.421 | 0.14 | 0.475 | 0.231 | 0.175 | 0.174 |

DKFZ corresponds to Genbank Accession numbers NP_112200, AAH09758, and NM_030938. Orthologs of DKFZ are identified in species other than Homo sapiens include NM_138839 from Rattus norvegicus.

Analysis of the sequence of DKFZ using a transmembrane helix prediction algorithm (Sonhammer, et al, A hidden Markov model for predicting transmembrane helices in protein sequences, In Proc. of Sixth Int. Conf. on Intelligent Systems for Molecular Biology, p. 175-82, Ed. J. Glasgow, T. Littlejohn, F. Major, R. Lathrop, D. Sankoff, and C. Sensen, Menlo Park, Calif.: AAAI Press, 1998) indicates that the DKFZ protein has six transmembrane regions (FIG. 18), and, as such, is likely to be a transmembrane protein.

Example 45

Antisense Regulation of DKFZ Expression

Additional functional information on DKFZ was generated using antisense knockout technology. A number of different oligonucleotides complementary to DKFZ mRNA were designed (AS) with corresponding controls (RC): GCTGCTGGATTCGTTTGGCATAACT (SEQ ID NO: 3013; CHIR180-7AS, DKFZp566I1:P1301AS), TCAATACGGTTTGCTTAGGTCGTCG (SEQ ID NO: 3014; CHIR180-7RC, DKFZp566I1:P1301RC), TCTCCTCTGAGTTCAACCGCTGCT (SEQ ID NO: 3015; CHIR180-8AS, DKFZp566I1:P1320AS) and TCGTCGCCAACTTGAGTCTCCTCT (SEQ ID NO: 3016; CHIR180-8RC, DKFZp566I1:P1320AS), and tested for their ability to suppress expression of DKFZ in human malignant colorectal carcinoma SW620 cells, human breast cancer MDA231 cells, and human breast cancer T4-2 cells, as described above.

Table 25 shows that the antisense (AS) oligonucleotides described above reduced expression of DKFZ mRNA as compared to controls in all three cell lines. DKFZ mRNA reduction ranged from about 95% to about 99%, as compared to cells transfected with reverse (i.e. sense) control (RC) oligonucleotides.

TABLE 25 antisense regulation of DKFZ mRNA

| Oligo | Cell Line | Gene Message | Actin Message | Ratio | Percent KO |
|---|---|---|---|---|---|
| CHIR180-7AS | SW620 | 0.0157 | 0.772 | 0.020 | 99.3 |
| CHIR180-7RC | SW620 | 1.99 | 0.736 | 2.70 | |
| CHIR180-8AS | SW620 | 0.0387 | 0.681 | 0.057 | 97.9 |
| CHIR180-8RC | SW620 | 1.89 | 0.703 | 2.69 | |
| CHIR180-7AS | MDA231 | 0.0471 | 3.58 | 0.013 | 98.5 |
| CHIR180-7RC | MDA231 | 1.99 | 2.33 | 0.854 | |
| CHIR180-8AS | MDA231 | 0.00935 | 1.74 | 0.00537 | 99.5 |
| CHIR180-8RC | MDA231 | 1.14 | 1.01 | 1.13 | |
| CHIR180-7AS | T4-2 | 0.119 | 0.667 | 0.178 | 95.4 |
| CHIR180-7RC | T4-2 | 2.8 | 0.728 | 3.85 | |
| CHIR180-8AS | T4-2 | 0.0852 | 0.751 | 0.113 | 95.6 |
| CHIR180-8RC | T4-2 | 1.6 | 0.620 | 2.58 | |

Example 46

Effect of DKFZ Expression on Cell Proliferation

The effect of gene expression on the inhibition of cell proliferation was assessed in metastatic breast cancer cell line MDA-231 and breast cancer cell line T4-2.

Cells were plated to approximately 60-80% confluency in 96-well dishes. Antisense or reverse control oligonucleotide was diluted to 2 μM in OptiMEM™ and added to OptiMEM™ into which a delivery vehicle, preferably a lipitoid or cholesteroid, had been diluted. The oligo/delivery vehicle mixture was then further diluted into medium with serum on the cells. The final concentration of oligonucleotide for all experiments was 300 nM, and the final ratio of oligo to delivery vehicle for all experiments was 1.5 nmol lipitoid/μg oligonucleotide.

Antisense oligonucleotides were prepared. Cells were transfected for 4 hours or overnight at 37° C. and the transfection mixture was replaced with fresh medium. Plates are incubated for 4 days, with a plate harvested for each day0-day4. To determine differences in cell number, a CyQuant Cell Proliferation Assay kit (Molecular Probes) was used per manufacturer's instructions. Fluorescence readings (480 nm excitation 520 nm emission) are taken after incubation for 5 minutes.

The results of these assays are shown in Tables 26 and 27. The data show that DKFZ antisense polynucleotides significantly reduce cell proliferation as compared to controls, and, as such, DKFZ plays a role in production or maintenance of the cancerous phenotype in cancerous breast cells.

TABLE 26

Cell proliferation

| Oligo | Cell Line | Ave Day 0 | Ave Day 1 | Ave Day 2 | Av3 Day 3 | Ave Day 4 |
|---|---|---|---|---|---|---|
| Untreated | MDA231 | 4233 | 4858 | 9544 | 10981 | 16776 |
| Untreated | MDA231 | 3849 | 4036 | 8686 | 9855 | 14865 |
| Pos Control | MDA231 | 3630 | 2236 | 3564 | 4536 | 7477 |
| Neg Control | MDA231 | 4913 | 5127 | 8331 | 8887 | 13620 |
| CHIR180-7AS | MDA231 | 3848 | 3476 | 6942 | 8715 | 11925 |
| CHIR180-7RC | MDA231 | 4895 | 4700 | 8484 | 10318 | 14226 |
| Untreated | T4-2 | 4062 | 3389 | 5438 | 10579 | 15617 |
| Untreated | T4-2 | 4209 | 3802 | 6346 | 11802 | 16275 |
| Pos Control | T4-2 | 3985 | 2712 | 4081 | 6404 | 9685 |
| Neg Control | T4-2 | 4051 | 3901 | 4356 | 9425 | 12964 |
| CHIR180-7AS | T4-2 | 3792 | 3201 | 3849 | 7376 | 10911 |
| CHIR180-7RC | T4-2 | 3967 | 3840 | 4321 | 8382 | 12293 |

TABLE 27

| | Standard Deviations | | | | | P-Value of T-Test | | | | |
|---|---|---|---|---|---|---|---|---|---|---|
| Oligo | Day 0 | Day 1 | Day 2 | Day 3 | Day 4 | Day 0 | Day 1 | Day 2 | Day 3 | Day 4 |
| Untreated | 337 | 269 | 299 | 697 | 1333 | 0.1306 | 0.1063 | 0.1804 | 0.0926 | 0.1225 |
| Untreated | 99 | 631 | 867 | 547 | 1047 | 0.1306 | 0.1063 | 0.1804 | 0.0926 | 0.1225 |
| Pos Control | 94 | 118 | 89 | 441 | 974 | 0.0000 | 0.0001 | 0.0003 | 0.0001 | 0.0010 |
| Neg Control | 2 | 252 | 697 | 195 | 780 | 0.0000 | 0.0001 | 0.0003 | 0.0001 | 0.0010 |
| CHIR180-7AS | 292 | 16 | 435 | 398 | 418 | 0.0072 | 0.0276 | 0.0059 | 0.0140 | 0.0028 |
| CHIR180-7RC | 208 | 6 | 244 | 533 | 440 | 0.0072 | 0.0276 | 0.0059 | 0.0140 | 0.0028 |
| Untreated | 64 | 283 | 789 | 1593 | 1226 | 0.2550 | 0.0921 | 0.1257 | 0.2794 | 0.4352 |
| Untreated | 22 | 158 | 205 | 577 | 478 | 0.2550 | 0.0921 | 0.1257 | 0.2794 | 0.4352 |
| Pos Control | 122 | 213 | 6 | 475 | 957 | 0.4320 | 0.0065 | 0.2624 | 0.0051 | 0.0293 |
| Neg Control | 47 | 335 | 464 | 809 | 1417 | 0.4320 | 0.0065 | 0.2624 | 0.0051 | 0.0293 |
| CHIR180-7AS | 170 | 679 | 263 | 127 | 1330 | 0.2638 | 0.0976 | 0.3516 | 0.0040 | 0.0039 |
| CHIR180-7RC | 22 | 453 | 646 | 579 | 884 | 0.2638 | 0.0976 | 0.3516 | 0.0040 | 0.0039 |

Example 47

Role of DKFZ in Anchorage Independent Cell Growth

The effect of DKFZ gene expression upon anchorage-independent cell growth of MDA435 and MCF7 human breast cancer cells was measured by colony formation in soft agar. Soft agar assays were conducted by the method described for GAK, above.

The data presented in Table 28 shows that the application of DKFZ antisense oligonucleotides to MDA435 and MCF7 cells results in inhibition of colony formation and shows that DKFZ plays a role in anchorage-independent cell growth of cancer cells. Table 28 shows the average fluorescence reading for several experiments. The standard deviation (St. Dev) of the fluorescence reading and coefficient of variation (% CV) and probability (P-value) is also shown.

TABLE 28

| Oligo | Cell Line | Average | St. Dev | % CV | P-Value |
|---|---|---|---|---|---|
| Untreated | MDA435 | 31190 | 5838 | 19 | 0.1342 |
| Untreated | MDA435 | 38623 | 3620 | 9 | 0.1342 |
| Pos Control | MDA435 | 4776 | 818 | 17 | 0.0156 |
| Neg Control | MDA435 | 16315 | 481 | 3 | 0.0156 |
| Chir180-7AS | MDA435 | 21161 | 3439 | 16 | 0.0274 |
| Chir180-7RC | MDA435 | 28868 | 1902 | 7 | 0.0274 |
| Untreated | MCF7 | 18954 | 1478 | 8 | 0.1476 |
| Untreated | MCF7 | 14383 | 4163 | 29 | 0.1476 |
| Pos Control | MCF7 | 1036 | 194 | 19 | 0.0036 |
| Neg Control | MCF7 | 9478 | 2382 | 25 | 0.0036 |
| Chir180-7AS | MCF7 | 4752 | 2002 | 42 | 0.0139 |
| Chir180-7RC | MCF7 | 9570 | 18 | 0 | 0.0139 |

The effect of DKFZ gene expression upon invasiveness of MDA231 human breast cancer cells was measured by a matrigel assay. A 3-dimensional reconstituted basement membrane culture of cells was generated as described previously (Peterson et al., (1992) Proc. Natl. Acad. Sci. USA 89:9064-9068) using a commercially prepared reconstituted basement membrane (Matrigel; Collaborative Research, Waltham, Mass.) and examined using methods well known in the art.

Figure 40:
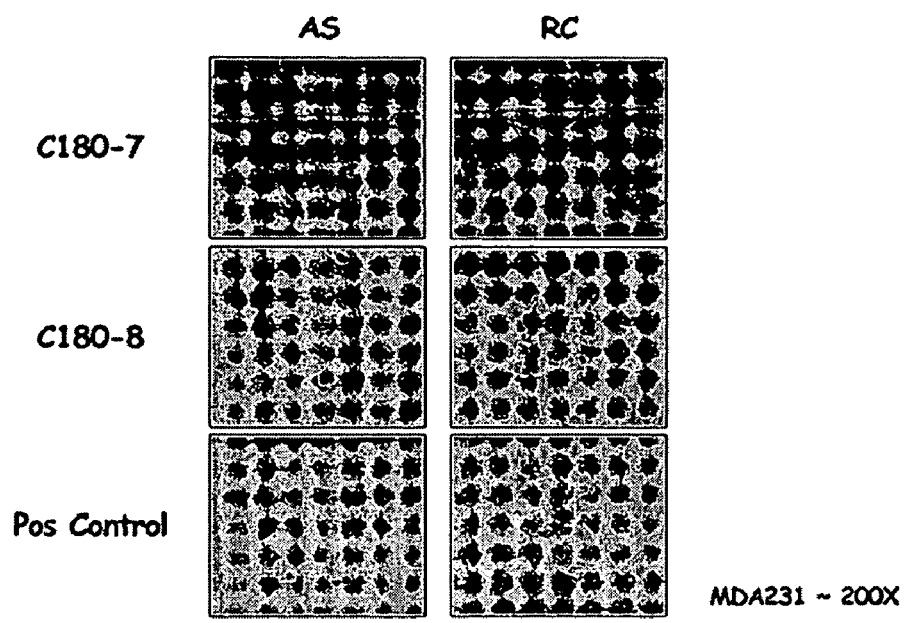
FIG. 40 is six panels of photographs of MDA-231 cells exposed to C180-7, C180-8 and positive control antisense (AS) and control (RC) oligonucleotides.

Table 29 (quantitated using Alamar Blue similar to the soft agar assay) and FIG. 40 provides exemplary results of the Matrigel invasion/motility assay to test the invasiveness of MDA231 cells with reduced expression of DKFZ. In general, these data show that a reduction in the expression of DKFZ significantly decreases the invasiveness of MDA231 cells.

TABLE 29

| Oligo | Cell Line | Average | St. Dev | % CV | P-Value |
|---|---|---|---|---|---|
| Untreated | MDA231 | 28316 | 13663 | 48 | 0.9080 |
| Untreated | MDA231 | 26840 | 15669 | 58 | 0.9080 |
| Pos Control | MDA231 | 2756 | 487 | 18 | 0.0002 |
| Neg Control | MDA231 | 14301 | 1386 | 10 | 0.0002 |
| Chir180-7AS | MDA231 | 10508 | 1963 | 19 | 0.0287 |
| Chir180-7RC | MDA231 | 14310 | 153 | 1 | 0.0287 |

Example 48

Expression of DKFZ in Cancer Tissues

The following peptides were used for polyclonal antibody production: peptide 809: gvhqqyvqriek (SEQ ID NO:2885), corresponding to amino acids 97-108 of the DKFZ protein and peptide 810: sgaepddeeyqef (SEQ ID NO: 2886), corresponding to amino acids 215-227 of the DKFZ protein.

Antibodies specific for DKFZ are used in FACS and immunolocalization analysis to show that DKFZ is associated with membrane, and up-regulated in cancer tissues of biopsies from cancer patients.

Further, antibodies specific for DKFZ are used to modulate DKFZ activity in cancerous breast, and is further used, alone or conjugated to a toxic moiety, as a treatment for breast cancer.

Example 49

Source of Biological Materials

The biological materials used in the experiments that led to the present invention are described below.

Source of Patient Tissue Samples

Normal and cancerous tissues were collected from patients using laser capture microdissection (LCM) techniques, which techniques are well known in the art (see, e.g., Ohyama et al. (2000) Biotechniques 29:530-6; Curran et al. (2000) Mol. Pathol. 53:64-8; Suarez-Quian et al. (1999) Biotechniques 26:328-35; Simone et al. (1998) Trends Genet 14:272-6; Conia et al. (1997) J. Clin. Lab. Anal. 11:28-38; Emmert-Buck et al. (1996) Science 274:998-1001). Table 30 provides information about each patient from which colon tissue samples were isolated, including: the Patient ID ("PT ID") and Path ReportID ("Path ID"), which are numbers assigned to the patient and the pathology reports for identification purposes; the group ("Grp") to which the patients have been assigned; the anatomical location of the tumor ("Anatom Loc"); the primary tumor size ("Size"); the primary tumor grade ("Grade"); the identification of the histopathological grade ("Histo Grade"); a description of local sites to which the tumor had invaded ("Local Invasion"); the presence of lymph node metastases ("Lymph Met"); the incidence of lymph node metastases (provided as a number of lymph nodes positive for metastasis over the number of lymph nodes examined) ("Lymph Met Incid"); the regional lymphnode grade ("Reg Lymph Grade"); the identification or detection of metastases to sites distant to the tumor and their location ("Dist Met & Loc"); the grade of distant metastasis ("Dist Met Grade"); and general comments about the patient or the tumor ("Comments"). Histopathology of all primary tumors indicated the tumor was adenocarcinoma except for Patient ID Nos. 130 (for which no information was provided), 392 (in which greater than 50% of the cells were mucinous carcinoma), and 784 (adenosquamous carcinoma). Extranodal extensions were described in three patients, Patient ID Nos. 784, 789, and 791. Lymphovascular invasion was described in Patient ID Nos. 128, 228, 278, 517, 534, 784, 786, 789, 791, 890, and 892. Crohn's-like infiltrates were described in seven patients, Patient ID Nos. 52, 264, 268, 392, 393, 784, and 791.

TABLE 30

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 10 | 16 | III | Cecum | 8.5 | T3 | G2 | through muscularis propria approaching pericolic fat, but not at serosal surface | Pos | 1/17 | N1 | Neg | M0 | Moderately differentiated |

TABLE 30-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 15 | 21 | III | Ascending colon | 4.0 | T3 | G2 | Extending into subserosal adipose tissue | Pos | 3/8 | N1 | Neg | MX | invasive adeno-carcinoma, moderately differentiated; focal perineural invasion is seen |
| 52 | 71 | II | Cecum | 9.0 | T3 | G3 | Invasion through muscularis propria, subserosal involvement; ileocec. valve involvement | Neg | 0/12 | N0 | Neg | M0 | Hyperplastic polyp in appendix. |
| 121 | 140 | II | Sigmoid | 6 | T4 | G2 | Invasion of muscularis propria into serosa, involving submucosa of urinary bladder | Neg | 0/34 | N0 | Neg | M0 | Perineural invasion; donut anastomosis Neg. One tubulovillous and one tubular adenoma with no high grade dysplasia. |
| 125 | 144 | II | Cecum | 6 | T3 | G2 | Invasion through the muscularis propria into suserosal adipose tissue. Ileocecal junction. | Neg | 0/19 | N0 | Neg | M0 | patient history of metastatic melanoma |
| 128 | 147 | III | Transverse colon | 5.0 | T3 | G2 | Invasion of muscularis propria into percolonic fat | Pos | 1/5 | N1 | Neg | M0 | |
| 130 | 149 | | Splenic flexure | 5.5 | T3 | | through wall and into surrounding adipose tissue | Pos | 10/24 | N2 | Neg | M1 | |
| 133 | 152 | II | Rectum | 5.0 | T3 | G2 | Invasion through muscularis propria into non-peritonealized pericolic tissue; gross configuration is annular. | Neg | 0/9 | N0 | Neg | M0 | Small separate tubular adenoma (0.4 cm) |
| 141 | 160 | IV | Cecum | 5.5 | T3 | G2 | Invasion of muscularis propria into pericolonic adipose tissue, but not through serosa. Arising from tubular adenoma. | Pos | 7/21 | N2 | Pos - Liver | M1 | Perineural invasion identified adjacent to metastatic adenocarcinoma. |
| 156 | 175 | III | Hepatic flexure | 3.8 | T3 | G2 | Invasion through mucsularis propria into subserosa/pericolic adipose, no serosal involvement. Gross configuration annular. | Pos | 2/13 | N1 | Neg | M0 | Separate tubolovillous and tubular adenomas |
| 228 | 247 | III | Rectum | 5.8 | T3 | G2 to G3 | Invasion through muscularis propria to involve subserosal, perirectoal adipose, and serosa | Pos | 1/8 | N1 | Neg | MX | Hyperplastic polyps |
| 264 | 283 | II | Ascending colon | 5.5 | T3 | G2 | Invasion through muscularis propria into subserosal adipose tissue. | Neg | 0/10 | N0 | Neg | M0 | Tubulovillous adenoma with high grade dysplasia |
| 266 | 285 | III | Transverse colon | 9 | T3 | G2 | Invades through muscularis propria to involve pericolonic adipose, extends to serosa. | Neg | 0/15 | N1 | Pos - Mesen-teric deposit | MX | |

TABLE 30-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 267 | 286 | III | Ileocecal | 4.5 | T2 | G2 | Confined to muscularis propria | Pos | 2/12 | N1 | Neg | M0 | |
| 268 | 287 | I | Cecum | 6.5 | T2 | G2 | Invades full thickness of muscularis propria, but mesenteric adipose free of malignancy | Neg | 0/12 | N0 | Neg | M0 | |
| 278 | 297 | III | Rectum | 4 | T3 | G2 | Invasion into perirectal adipose tissue. | Pos | 7/10 | N2 | Neg | M0 | Descending colon polyps, no HGD or carcinoma identified.. |
| 295 | 314 | II | Ascending colon | 5.0 | T3 | G2 | Invasion through muscularis propria into percolic adipose tissue. | Neg | 0/12 | N0 | Neg | M0 | Melanosis coli and diverticular disease. |
| 296 | 315 | III | Cecum | 5.5 | T3 | G2 | Invasion through muscularis propria and invades pericolic adipose tissue. Ileocecal junction. | Pos | 2/12 | N1 | Neg | M0 | Tubulovillous adenoma (2.0 cm) with no high grade dysplasia. Neg. liver biopsy. |
| 300 | 319 | III | Descending colon | 5.2 | T2 | G2 | through the muscularis propria into pericolic fat | Pos | 2/2 | N1 | Neg | M0 | |
| 322 | 341 | II | Sigmoid | 7 | T3 | G2 | through the muscularis propria into pericolic fat | Neg | 0/5 | N0 | Neg | M0 | vascular invasion is identified |
| 339 | 358 | II | Recto-sigmoid | 6 | T3 | G2 | Extends into perirectal fat but does not reach serosa | Neg | 0/6 | N0 | Neg | M0 | 1 hyperplastic polyp identified |
| 341 | 360 | II | Ascending colon | 2 cm invasive | T3 | G2 | Invasion through muscularis propria to involve pericolonic fat. Arising from villous adenoma. | Neg | 0/4 | N0 | Neg | MX | |
| 356 | 375 | II | Sigmoid | 6.5 | T3 | G2 | Through colon wall into subserosal adipose tissue. No serosal spread seen. | Neg | 0/4 | N0 | Neg | M0 | |
| 360 | 412 | III | Ascending colon | 4.3 | T3 | G2 | Invasion thru muscularis propria to pericolonic fat | Pos | 1/5 | N1 | Neg | M0 | Two mucosal polyps |
| 392 | 444 | IV | Ascending colon | 2 | T3 | G2 | Invasion through muscularis propria into subserosal adipose tissue, not serosa. | Pos | 1/6 | N1 | Pos - Liver | M1 | Tumor arising at prior ileocolic surgical anastomosis. |
| 393 | 445 | II | Cecum | 6.0 | T3 | G2 | Cecum, invades through muscularis propria to involve subserosal adipose tissue but not serosa. | Neg | 0/21 | N0 | Neg | M0 | |
| 413 | 465 | IV | Cecum | 4.8 | T3 | G2 | Invasive through muscularis to involve periserosal fat; abutting ileocecal junction. | Neg | 0/7 | N0 | Pos - Liver | M1 | rediagnosis of oophorectomy path to metastatic colon cancer. |
| 452 | 504 | II | Ascending colon | 4 | T3 | G2 | through muscularis propria approaching pericolic fat, but not at serosal surface | Neg | 0/39 | N0 | Neg | M0 | |
| 505 | 383 | IV | | 7.5 | T3 | G2 | Invasion through muscularis propria involving pericolic adipose, serosal surface uninvolved | Pos | 2/17 | N1 | Pos - Liver | M1 | Anatomical location of primary not notated in report. |

TABLE 30-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 517 | 395 | IV | Sigmoid | 3 | T3 | G2 | penetrates muscularis propria, involves pericolonic fat. | Pos | 6/6 | N2 | Neg | M0 | Evidence of chronic colitis. No mention of distant met in report |
| 534 | 553 | II | Ascending colon | 12 | T3 | G3 | Invasion through the muscularis propria involving pericolic fat. Serosa free of tumor. | Neg | 0/8 | N0 | Neg | M0 | Omentum with fibrosis and fat necrosis. Small bowel with acute and chronic serositis, focal abscess and adhesions. |
| 546 | 565 | IV | Ascending colon | 5.5 | T3 | G2 | Invasion through muscularis propria extensively through submucosal and extending to serosa. | Pos | 6/12 | N2 | Pos - Liver | M1 | |
| 577 | 596 | II | Cecum | 11.5 | T3 | G2 | Invasion through the bowel wall, into suberosal adipose. Serosal surface free of tumor. | Neg | 0/58 | N0 | Neg | M0 | Appendix dilated and fibrotic, but not involved by tumor |
| 695 | 714 | II | Cecum | 14.0 | T3 | G2 | extending through bowel wall into serosal fat | Neg | 0/22 | N0 | Neg | MX | moderately differentiated adenocarcinoma with mucinous diferentiation (% not stated), tubular adenoma and hyperplstic polyps present, invasive poorly differentiated adenosquamous carcinoma |
| 784 | 803 | IV | Ascending colon | 3.5 | T3 | G3 | through muscularis propria into pericolic soft tissues | Pos | 5/17 | N2 | Pos - Liver | M1 | |
| 786 | 805 | IV | Descending colon | 9.5 | T3 | G2 | through muscularis propria into pericolic fat, but not at serosal surface | Neg | 0/12 | N0 | Pos - Liver | M1 | moderately differentiated invasive adenocarcinoma |
| 787 | 806 | II | Recto-sigmoid | 2.5 | T3 | G2-G3 | Invasion of muscularis propria into soft tissue | Neg | | N0 | Neg | MX | Peritumoral lymphocytic response; 5 LN examined in pericolic fat, no metastatses observed. |
| 789 | 808 | IV | Cecum | 5.0 | T3 | G2-G3 | Extending through muscularis propria into pericolonic fat | Pos | 5/10 | N2 | Pos - Liver | M1 | Three fungating lesions examined. |
| 790 | 809 | IV | Rectum | 6.8 | T3 | G1-G2 | Invading through muscularis propria into perirectal fat | Pos | 3/13 | N1 | Pos - Liver | M1 | |
| 791 | 810 | IV | Ascending colon | 5.8 | T3 | G3 | Through the muscularis propria into pericolic fat | Pos | 13/25 | N2 | Pos - Liver | M1 | poorly differentiated invasive colonic adenocarcinoma |
| 888 | 908 | IV | Ascending colon | 2.0 | T2 | G1 | Into muscularis propria | Pos | 3/21 | N0 | Pos - Liver | M1 | well to moderately differentiated adenocarcinomas; this patient has tumors of the ascending colon and the sigmoid colon |

TABLE 30-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 889 | 909 | IV | Cecum | 4.8 | T3 | G2 | Through muscularis propria int subserosal tissue | Pos | 1/4 | N1 | Pos - Liver | M1 | moderately differentiated adenocarcinoma |
| 890 | 910 | IV | Ascending colon | | T3 | G2 | Through muscularis propria into subserosa. | Pos | 11/15 | N2 | Pos - Liver | M1 | |
| 891 | 911 | IV | Rectum | 5.2 | T3 | G2 | Invasion through muscularis propria into perirectal soft tissue | Pos | 4/15 | N2 | Pos - Liver | M1 | Perineural invasion present. |
| 892 | 912 | IV | Sigmoid | 5.0 | T3 | G2 | Invasion into pericolic sort tissue. Tumor focally invading skeletal muscle attached to colon. | Pos | 1/28 | N1 | Pos - Liver, left and right lobe, omentum | M1 | Perineural invasion present, extensive. Patient with a history of colon cancer. |
| 893 | 913 | IV | Transverse colon | 6.0 | T3 | G2-G3 | Through muscularis propria into pericolic fat | Pos | 14/17 | N2 | Pos - Liver | M1 | Perineural invasion focally present. Omentum mass, but resection with no tumor identified. |
| 989 | 1009 | IV | Sigmoid | 6.0 | T3 | G2 | Invasion through colon wall and focally involving subserosal tissue. | Pos | 1/7 | N1 | Pos - Liver | M1 | Primary adenocarcinoma arising from tubulovillous adenoma. |

Source of Polynucleotides on Arrays

Polynucleotides for use on the arrays were obtained from both publicly available sources and from cDNA libraries generated from selected cell lines and patient tissues. Table 31 provides information about the polynucleotides on the arrays including: (1) the "SEQ ID NO" assigned to each sequence for use in the present specification; (2) the spot identification number ("Spot ID"), an internal reference that serves as a unique identifier for the spot on the array; (3) the "Clone ID" assigned to the clone from which the sequence was isolated; and (4) the "MAClone ID" assigned to the clone from which the sequence was isolated. The sequences corresponding to the SEQ ID NOS are provided in the Sequence Listing.

TABLE 31

| SEQ ID NO | Spot ID | Clone ID | MAClone ID |
|---|---|---|---|
| 3022 | 18 | M00026919B:A10 | MA40:F01 |
| 3023 | 20 | M00026919B:E07 | MA40:G01 |
| 3024 | 22 | M00026919D:F04 | MA40:H01 |
| 3025 | 54 | M00026914D:G06 | MA40:A01 |
| 3026 | 56 | M00026950A:A09 | MA40:D07 |
| 3027 | 67 | M00003820C:A09 | MA244:B01 |
| 3028 | 73 | M00001673A:G03 | MA244:E01 |
| 3029 | 115 | M00007939A:A12 | MA27:B07 |
| 3030 | 119 | M00007939A:B11 | MA27:D07 |
| 3031 | 127 | M00007939B:G03 | MA27:H07 |
| 3032 | 166 | M00007997D:G08 | MA29:C01 |
| 3033 | 220 | M00026894C:E11 | MA39:F07 |
| 3034 | 238 | M00001391A:C05 | MA15:G01 |
| 3035 | 294 | M00006818A:A06 | MA240:C01 |
| 3036 | 393 | M00023278A:F09 | MA36:E01 |
| 3037 | 405 | M00023299A:G01 | MA36:C07 |
| 3038 | 411 | M00023301A:A11 | MA36:F07 |
| 3039 | 453 | M00008050A:D12 | MA30:C01 |
| 3040 | 460 | M00022135A:C04 | MA35:F01 |
| 3041 | 462 | M00022137A:A05 | MA35:G01 |
| 3042 | 466 | M00022176C:A07 | MA35:A07 |
| 3043 | 471 | M00008077B:A08 | MA30:D07 |
| 3044 | 477 | M00008077C:D09 | MA30:G07 |
| 3045 | 492 | M00022081C:E09 | MA34:F01 |
| 3046 | 495 | M00001662A:G06 | MA24:H01 |
| 3047 | 504 | M00022102B:B11 | MA34:D07 |
| 3048 | 506 | M00022102B:E08 | MA34:E07 |
| 3049 | 556 | M00022569D:G06 | MA22:F01 |
| 3050 | 577 | M00001358B:B11 | MA14:A01 |
| 3051 | 578 | M00001429A:G04 | MA16:A01 |
| 3052 | 579 | M00001358B:F05 | MA14:B01 |
| 3053 | 582 | M00001429C:C03 | MA16:C01 |
| 3054 | 585 | M00001359D:B04 | MA14:E01 |
| 3055 | 587 | M00001360A:E10 | MA14:F01 |
| 3056 | 589 | M00001360C:B05 | MA14:G01 |
| 3057 | 590 | M00001430B:F01 | MA16:G01 |
| 3058 | 592 | M00001430C:A02 | MA16:H01 |
| 3059 | 594 | M00001445C:H05 | MA16:A07 |
| 3060 | 596 | M00001445D:D07 | MA16:B07 |
| 3061 | 605 | M00001374D:D10 | MA14:G07 |
| 3062 | 607 | M00001375A:A08 | MA14:H07 |
| 3063 | 643 | M00006600A:E07 | MA241:B01 |
| 3064 | 661 | M00006690A:F06 | MA241:C07 |
| 3065 | 739 | M00023325D:A08 | MA37:B02 |
| 3066 | 742 | M00026921D:F12 | MA40:C02 |
| 3067 | 743 | M00023325D:F06 | MA37:D02 |
| 3068 | 750 | M00026924A:E09 | MA40:G02 |
| 3069 | 823 | M00007940C:A04 | MA27:D08 |
| 3070 | 827 | M00007941C:H03 | MA27:F08 |
| 3071 | 828 | M00021638B:F03 | MA31:F08 |
| 3072 | 831 | M00007941D:C04 | MA27:H08 |
| 3073 | 842 | M00004054D:D02 | |

TABLE 31-continued

| SEQ ID NO | Spot ID | Clone ID | MAClone ID |
|---|---|---|---|
| 3074 | 857 | M00001507A:A10 | MA23:E08 |
| 3075 | 858 | M00004198D:A01 | |
| 3076 | 861 | M00001528C:B08 | MA23:G08 |
| 3077 | 868 | M00008002C:A05 | MA29:B03 |
| 3078 | 880 | M00008006C:H05 | MA29:H03 |
| 3079 | 898 | M00026850C:A01 | MA39:A02 |
| 3080 | 908 | M00026853D:C07 | MA39:F02 |
| 3081 | 920 | M00026896A:C09 | MA39:D08 |
| 3082 | 934 | M00001391B:D02 | MA15:C02 |
| 3083 | 938 | M00001391B:H05 | MA15:E02 |
| 3084 | 940 | M00001391D:C07 | MA15:F02 |
| 3085 | 942 | M00001392B:B01 | MA15:G02 |
| 3086 | 954 | M00001407B:C03 | MA15:E08 |
| 3087 | 1011 | M00005635B:E02 | MA242:B08 |
| 3088 | 1017 | M00005636B:B06 | MA242:E08 |
| 3089 | 1018 | M00006971A:E06 | MA240:E08 |
| 3090 | 1019 | M00005636D:B08 | MA242:F08 |
| 3091 | 1107 | M00023302C:A04 | MA36:B08 |
| 3092 | 1117 | M00023305A:C02 | MA36:G08 |
| 3093 | 1172 | M00022180A:E08 | MA35:B08 |
| 3094 | 1178 | M00022181C:H11 | MA35:E08 |
| 3095 | 1193 | M00001673A:C11 | |
| 3096 | 1201 | M00003853B:C07 | |
| 3097 | 1204 | M00022106B:D04 | MA34:B08 |
| 3098 | 1209 | M00003858B:G01 | MA24:E08 |
| 3099 | 1214 | M00022109B:A11 | MA34:G08 |
| 3100 | 1260 | M00022921A:H05 | MA22:F02 |
| 3101 | 1282 | M00001430D:H07 | MA16:A02 |
| 3102 | 1283 | M00001360D:H10 | MA14:B02 |
| 3103 | 1284 | M00001431A:E01 | MA16:B02 |
| 3104 | 1285 | M00001361A:A02 | MA14:C02 |
| 3105 | 1295 | M00001362A:B03 | MA14:H02 |
| 3106 | 1297 | M00001376C:C01 | MA14:A08 |
| 3107 | 1300 | M00001449A:D02 | MA16:B08 |
| 3108 | 1301 | M00001378B:A02 | MA14:C08 |
| 3109 | 1302 | M00001450A:D12 | MA16:C08 |
| 3110 | 1303 | M00001378C:D08 | MA14:D08 |
| 3111 | 1310 | M00001451D:F01 | MA16:G08 |
| 3112 | 1349 | M00006628B:A02 | MA241:C02 |
| 3113 | 1444 | M00026926C:F03 | MA40:B03 |
| 3114 | 1458 | M00026963B:H03 | MA40:A09 |
| 3115 | 1464 | M00026964A:E10 | MA40:D09 |
| 3116 | 1468 | M00026965C:A11 | MA40:F09 |
| 3117 | 1493 | M00001398A:D11 | MA244:C09 |
| 3118 | 1512 | M00008095C:H08 | MA31:D03 |
| 3119 | 1523 | M00007942A:F12 | MA27:B09 |
| 3120 | 1554 | M00004212B:B12 | MA25:A09 |
| 3121 | 1576 | M00008014C:E11 | MA29:D05 |
| 3122 | 1578 | M00008015A:B05 | MA29:E05 |
| 3123 | 1586 | M00022049A:B08 | MA33:A05 |
| 3124 | 1602 | M00026856B:F08 | MA39:A03 |
| 3125 | 1604 | M00026856C:H12 | MA39:B03 |
| 3126 | 1628 | M00026900D:A03 | MA39:F09 |
| 3127 | 1630 | M00026900D:C12 | MA39:G09 |
| 3128 | 1632 | M00026901D:A03 | MA39:H09 |
| 3129 | 1642 | M00001393A:G03 | MA15:E03 |
| 3130 | 1656 | M00001409B:D03 | MA15:D09 |
| 3131 | 1658 | M00001409B:G01 | MA15:E09 |
| 3132 | 1660 | M00001410C:C09 | MA15:F09 |
| 3133 | 1662 | M00001410D:A03 | MA15:G09 |
| 3134 | 1697 | M00005504D:F06 | MA242:A03 |
| 3135 | 1709 | M00005510D:H10 | MA242:G03 |
| 3136 | 1726 | M00006990D:D06 | MA240:G09 |
| 3137 | 1761 | SL146 | MA248:A03 |
| 3138 | 1775 | SL153 | MA248:H03 |
| 3139 | 1785 | SL198 | MA248:E09 |
| 3140 | 1787 | SL199 | MA248:F09 |
| 3141 | 1789 | SL200 | MA248:G09 |
| 3142 | 1797 | M00023283D:C03 | MA36:C03 |
| 3143 | 1799 | M00023283D:D03 | MA36:D03 |
| 3144 | 1801 | M00023284A:D09 | MA36:E03 |
| 3145 | 1807 | M00023285D:C05 | MA36:H03 |
| 3146 | 1809 | M00023306C:H11 | MA36:A09 |
| 3147 | 1813 | M00023308B:B06 | MA36:C09 |
| 3148 | 1817 | M00023309D:H04 | MA36:E09 |
| 3149 | 1819 | M00023310A:D07 | MA36:F09 |
| 3150 | 1875 | M00008079C:H04 | MA30:B09 |
| 3151 | 1883 | M00008080B:B10 | MA30:F09 |
| 3152 | 1884 | M00022198D:C02 | MA35:F09 |
| 3153 | 1886 | M00022198D:G03 | MA35:G09 |
| 3154 | 1895 | M00003768B:B09 | MA24:D03 |
| 3155 | 1910 | M00022110C:A08 | MA34:C09 |
| 3156 | 1913 | M00003886C:H08 | MA24:E09 |
| 3157 | 1960 | M00023297B:A10 | MA22:D03 |
| 3158 | 1966 | M00023314C:G05 | MA22:G03 |
| 3159 | 1991 | M00001363B:C04 | MA14:D03 |
| 3160 | 1992 | M00001434D:F08 | MA16:D03 |
| 3161 | 1994 | M00001435B:A04 | MA16:E03 |
| 3162 | 1996 | M00001435B:B09 | MA16:F03 |
| 3163 | 2000 | M00001435C:F08 | MA16:H03 |
| 3164 | 2001 | M00001381A:F03 | MA14:A09 |
| 3165 | 2004 | M00001453B:E11 | MA16:B09 |
| 3166 | 2008 | M00001453C:D02 | MA16:D09 |
| 3167 | 2050 | M00007121D:A05 | MA243:A03 |
| 3168 | 2052 | M00007122C:F03 | MA243:B03 |
| 3169 | 2053 | M00006638A:G02 | MA241:C03 |
| 3170 | 2059 | M00006639B:H09 | MA241:F03 |
| 3171 | 2064 | M00007127C:C11 | MA243:H03 |
| 3172 | 2073 | M00006720D:C11 | MA241:E09 |
| 3173 | 2075 | M00006728C:E07 | MA241:F09 |
| 3174 | 2156 | M00026931D:E08 | MA40:F04 |
| 3175 | 2158 | M00026932D:B08 | MA40:G04 |
| 3176 | 2168 | M00026969D:D02 | MA40:D10 |
| 3177 | 2169 | M00023393B:E02 | MA37:E10 |
| 3178 | 2185 | M00003782D:D06 | MA244:E04 |
| 3179 | 2189 | M00004105D:B04 | MA244:G04 |
| 3180 | 2199 | M00001556D:B11 | MA244:D10 |
| 3181 | 2234 | M00021664B:G03 | MA31:E10 |
| 3182 | 2242 | M00004078A:A07 | |
| 3183 | 2263 | M00001561A:B03 | MA23:D10 |
| 3184 | 2284 | M00008023C:A06 | MA29:F07 |
| 3185 | 2286 | M00008024C:F02 | MA29:G07 |
| 3186 | 2288 | M00008024C:G06 | MA29:H07 |
| 3187 | 2292 | M00022057C:H10 | MA33:B07 |
| 3188 | 2294 | M00022059B:B06 | MA33:C07 |
| 3189 | 2324 | M00026902B:F10 | MA39:B10 |
| 3190 | 2342 | M00001394D:B08 | MA15:C04 |
| 3191 | 2354 | M00001415A:G05 | MA15:A10 |
| 3192 | 2356 | M00001416B:E03 | MA15:B10 |
| 3193 | 2368 | M00001421B:B12 | MA15:H10 |
| 3194 | 2413 | M00005528C:E02 | MA242:G04 |
| 3195 | 2513 | M00023312D:F10 | MA36:A10 |
| 3196 | 2566 | M00022157A:C06 | MA35:C04 |
| 3197 | 2576 | M00022165A:A11 | MA35:H04 |
| 3198 | 2584 | M00022206A:B10 | MA35:D10 |
| 3199 | 2601 | M00003811B:F09 | |
| 3200 | 2605 | M00003812D:A11 | |
| 3201 | 2606 | M00022088D:C10 | MA34:G04 |
| 3202 | 2613 | M00003910B:C12 | |
| 3203 | 2689 | M00001366A:F06 | MA14:A04 |
| 3204 | 2692 | M00001435C:F12 | MA16:B04 |
| 3205 | 2694 | M00001436B:E11 | MA16:C04 |
| 3206 | 2695 | M00001366B:E01 | MA14:D04 |
| 3207 | 2696 | M00001436C:C03 | MA16:D04 |
| 3208 | 2700 | M00001437A:B01 | MA16:F04 |
| 3209 | 2702 | M00001437B:B08 | MA16:G04 |
| 3210 | 2712 | M00001467B:H05 | |
| 3211 | 2716 | M00001468A:D02 | MA16:F10 |
| 3212 | 2756 | M00007131B:B11 | MA243:B04 |
| 3213 | 2761 | M00006650A:A10 | MA241:E04 |
| 3214 | 2765 | M00006653C:B09 | MA241:G04 |
| 3215 | 2766 | M00007154B:H08 | MA243:G04 |
| 3216 | 2769 | M00006740A:E02 | MA241:A10 |
| 3217 | 2770 | M00021621A:D04 | MA243:A10 |
| 3218 | 2771 | M00006740B:F11 | MA241:B10 |
| 3219 | 2773 | M00006741C:A01 | MA241:C10 |
| 3220 | 2780 | M00022171C:A04 | MA243:F10 |
| 3221 | 2858 | M00026937C:B08 | MA40:E05 |
| 3222 | 2861 | M00023367A:H06 | MA37:G05 |
| 3223 | 2876 | M00026985C:E12 | MA40:F11 |
| 3224 | 2916 | M00008100A:A07 | MA31:B05 |
| 3225 | 2921 | M00007936B:H07 | MA27:E05 |
| 3226 | 2924 | M00008100C:E05 | MA31:F05 |
| 3227 | 2937 | M00007947B:B02 | MA27:E11 |

TABLE 31-continued

| SEQ ID NO | Spot ID | Clone ID | MAClone ID |
|---|---|---|---|
| 3228 | 2956 | M00004105A:C09 | MA25:F05 |
| 3229 | 2957 | M00001433C:D09 | MA23:G05 |
| 3230 | 2980 | M00008027B:D09 | MA29:B09 |
| 3231 | 2984 | M00008028D:B01 | MA29:D09 |
| 3232 | 2988 | M00008039A:C09 | MA29:F09 |
| 3233 | 3026 | M00026905A:A10 | MA39:A11 |
| 3234 | 3030 | M00026905D:C05 | MA39:C11 |
| 3235 | 3054 | M00001401B:A06 | MA15:G05 |
| 3236 | 3056 | M00001402A:A08 | MA15:H05 |
| 3237 | 3105 | M00005534C:E12 | MA242:A05 |
| 3238 | 3111 | M00005542A:D09 | MA242:D05 |
| 3239 | 3132 | M00007031D:E02 | MA240:F11 |
| 3240 | 3134 | M00007032A:D04 | MA240:G11 |
| 3241 | 3135 | M00005813C:F12 | MA242:H11 |
| 3242 | 3171 | SL163 | MA248:B05 |
| 3243 | 3173 | SL164 | MA248:C05 |
| 3244 | 3179 | SL167 | MA248:F05 |
| 3245 | 3181 | SL168 | MA248:G05 |
| 3246 | 3183 | SL169 | MA248:H05 |
| 3247 | 3231 | M00023320B:A03 | MA36:H11 |
| 3248 | 3238 | M00005350B:F10 | MA246:C05 |
| 3249 | 3267 | M00008069D:F01 | MA30:B05 |
| 3250 | 3268 | M00022165B:C08 | MA35:B05 |
| 3251 | 3272 | M00022165C:E12 | MA35:D05 |
| 3252 | 3274 | M00022166C:E07 | MA35:E05 |
| 3253 | 3275 | M00008072D:E12 | MA30:F05 |
| 3254 | 3282 | M00022211B:D05 | MA35:A11 |
| 3255 | 3293 | M00008089A:E09 | MA30:G11 |
| 3256 | 3317 | M00003974D:E04 | MA24:C11 |
| 3257 | 3323 | M00003980D:F10 | MA24:F11 |
| 3258 | 3327 | M00003984D:C08 | MA24:H11 |
| 3259 | 3370 | M00023373D:A01 | MA22:E05 |
| 3260 | 3376 | M00023396D:D01 | MA22:H05 |
| 3261 | 3394 | M00001437D:E12 | MA16:A05 |
| 3262 | 3396 | M00001438A:B09 | MA16:B05 |
| 3263 | 3401 | M00001369A:C07 | MA14:E05 |
| 3264 | 3404 | M00001439C:A07 | MA16:F05 |
| 3265 | 3407 | M00001369C:A05 | MA14:H05 |
| 3266 | 3410 | M00001468D:B11 | MA16:A11 |
| 3267 | 3411 | M00001386B:F08 | MA14:B11 |
| 3268 | 3419 | M00001387A:A08 | MA14:F11 |
| 3269 | 3460 | M00007163A:B10 | MA243:B05 |
| 3270 | 3465 | M00006675C:A06 | MA241:E05 |
| 3271 | 3470 | M00007191C:A06 | MA243:G05 |
| 3272 | 3471 | M00006678A:D02 | MA241:H05 |
| 3273 | 3562 | M00026941C:A12 | MA40:E06 |
| 3274 | 3578 | M00026996A:E01 | MA40:E12 |
| 3275 | 3581 | M00023401B:E06 | MA37:G12 |
| 3276 | 3584 | M00027005B:D03 | MA40:H12 |
| 3277 | 3621 | M00007937B:A02 | MA27:C06 |
| 3278 | 3622 | M00021612C:E11 | MA31:C06 |
| 3279 | 3629 | M00007938C:C12 | MA27:G06 |
| 3280 | 3675 | M00001623C:A06 | MA23:F12 |
| 3281 | 3677 | M00001630D:A11 | MA23:G12 |
| 3282 | 3682 | M00008044B:E11 | MA29:A11 |
| 3283 | 3684 | M00008044C:C10 | MA29:B11 |
| 3284 | 3686 | M00008044D:B08 | MA29:C11 |
| 3285 | 3688 | M00008044D:C05 | MA29:D11 |
| 3286 | 3706 | M00022074C:A04 | MA33:E11 |
| 3287 | 3738 | M00026910C:D12 | MA39:E12 |
| 3288 | 3742 | M00026913A:D06 | MA39:G12 |
| 3289 | 3752 | M00001402C:H08 | MA15:D06 |
| 3290 | 3756 | M00001404C:C11 | MA15:F06 |
| 3291 | 3813 | M00005588B:G05 | MA242:C06 |
| 3292 | 3814 | M00006934D:D10 | MA240:C06 |
| 3293 | 3885 | SL176 | MA248:G06 |
| 3294 | 3905 | M00023295D:E05 | MA36:A06 |
| 3295 | 3921 | M00023320B:C02 | MA36:A12 |
| 3296 | 3956 | M00005401B:F12 | MA246:B12 |
| 3297 | 3979 | M00008074D:C05 | MA30:F06 |
| 3298 | 3982 | M00022175B:F06 | MA35:G06 |
| 3299 | 3998 | M00022230B:C10 | MA35:G12 |
| 3300 | 4006 | M00022093C:C08 | MA34:C06 |
| 3301 | 4008 | M00022093C:C12 | MA34:D06 |
| 3302 | 4028 | M00022132A:H07 | MA34:F12 |
| 3303 | 4066 | M00023397B:D04 | MA22:A06 |
| 3304 | 4074 | M00023399D:G04 | MA22:E06 |
| 3305 | 4098 | M00001439D:C09 | MA16:A06 |
| 3306 | 4100 | M00001441A:A09 | MA16:B06 |
| 3307 | 4101 | M00001369D:E02 | MA14:C06 |
| 3308 | 4105 | M00001371D:H10 | MA14:E06 |
| 3309 | 4107 | M00001372A:D01 | MA14:F06 |
| 3310 | 4110 | M00001444C:F03 | MA16:G06 |
| 3311 | 4112 | M00001445A:B02 | |
| 3312 | 4119 | M00001388D:F11 | MA14:D12 |
| 3313 | 4124 | M00001481C:A12 | MA16:F12 |
| 3314 | 4125 | M00001389B:B05 | MA14:G12 |
| 3315 | 4127 | M00001389C:G01 | MA14:H12 |
| 3316 | 4128 | M00001482D:D11 | MA16:H12 |
| 3317 | 4183 | M00006809B:F04 | MA241:D12 |
| 3318 | 8513 | I:3325119:07A01:A01 | MA127:A01 |
| 3319 | 8517 | I:3033345:07A01:C01 | MA127:C01 |
| 3320 | 8537 | I:3176222:07A01:E07 | MA127:E07 |
| 3321 | 8542 | I:2510627:07B01:G07 | MA129:G07 |
| 3322 | 8546 | I:1705208:06B01:A01 | MA125:A01 |
| 3323 | 8566 | I:1672781:06B01:C07 | MA125:C07 |
| 3324 | 8568 | I:1712888:06B01:D07 | MA125:D07 |
| 3325 | 8570 | I:1696224:06B01:E07 | MA125:E07 |
| 3326 | 8576 | I:3935034:06B01:H07 | MA125:H07 |
| 3327 | 8617 | I:1800114:03A01:E01 | MA111:E01 |
| 3328 | 8631 | I:1976029:03A01:D07 | MA111:D07 |
| 3329 | 8634 | I:1439934:03B01:E07 | MA113:E07 |
| 3330 | 8645 | I:2512879:01A01:C01 | MA103:C01 |
| 3331 | 8660 | I:2900277:01B01:B07 | MA105:B07 |
| 3332 | 8661 | I:1479255:01A01:C07 | MA103:C07 |
| 3333 | 8738 | I:2648612:04B01:A01 | MA117:A01 |
| 3334 | 8741 | I:1889867:04A01:C01 | MA115:C01 |
| 3335 | 8743 | I:1858905:04A01:D01 | MA115:D01 |
| 3336 | 8752 | I:2591494:04B01:H01 | MA117:H01 |
| 3337 | 8754 | I:2916261:04B01:A07 | MA117:A07 |
| 3338 | 8756 | I:2397815:04B01:B07 | MA117:B07 |
| 3339 | 8760 | I:2182095:04B01:D07 | MA117:D07 |
| 3340 | 8769 | I:2506194:02A01:A01 | MA107:A01 |
| 3341 | 8773 | I:1806219:02A01:C01 | MA107:C01 |
| 3342 | 8797 | I:1729724:02A01:G07 | MA107:G07 |
| 3343 | 8845 | I:1886842:05A02:G01 | MA120:G01 |
| 3344 | 8851 | I:1352669:05A02:B07 | MA120:B07 |
| 3345 | 8854 | I:1755847:05B02:C07 | MA122:C07 |
| 3346 | 8856 | I:1803418:05B02:D07 | MA122:D07 |
| 3347 | 8860 | I:1568725:05B02:F07 | MA122:F07 |
| 3348 | 8861 | I:1857708:05A02:G07 | MA120:G07 |
| 3349 | 8862 | I:1687060:05B02:G07 | MA122:G07 |
| 3350 | 8881 | I:3407289:07A02:A07 | MA128:A07 |
| 3351 | 8883 | I:1235535:07A02:B07 | MA128:B07 |
| 3352 | 8984 | I:1525795:03B02:D07 | MA114:D07 |
| 3353 | 8991 | I:3744592:03A02:H07 | MA112:H07 |
| 3354 | 8995 | I:1485817:01A02:B01 | MA104:B01 |
| 3355 | 8996 | I:2365149:01B02:B01 | MA106:B01 |
| 3356 | 8999 | I:1439677:01A02:D01 | MA104:D01 |
| 3357 | 9006 | I:2372275:01B02:G01 | MA106:G01 |
| 3358 | 9008 | I:3211615:01B02:H01 | MA106:H01 |
| 3359 | 9012 | I:2368282:01B02:B07 | MA106:B07 |
| 3360 | 9095 | I:1737833:04A02:D01 | MA116:D01 |
| 3361 | 9100 | I:2382192:04B02:F01 | MA118:F01 |
| 3362 | 9111 | I:1958902:04A02:D07 | MA116:D07 |
| 3363 | 9118 | I:1704472:04B02:G07 | MA118:G07 |
| 3364 | 9119 | I:1903767:04A02:H07 | MA116:H07 |
| 3365 | 9125 | I:1268080:02A02:C01 | MA108:C01 |
| 3366 | 9141 | I:1347384:02A02:C07 | MA108:C07 |
| 3367 | 9168 | I:2344817:08B01:H02 | MA133:H02 |
| 3368 | 9171 | I:3236109:08A01:B08 | MA131:B08 |
| 3369 | 9247 | I:2832506:07A01:H08 | MA127:H08 |
| 3370 | 9252 | I:1673876:06B01:B02 | MA125:B02 |
| 3371 | 9258 | I:3686211:06B01:E02 | MA125:E02 |
| 3372 | 9264 | I:2449837:06B01:H02 | MA125:H02 |
| 3373 | 9270 | I:1613874:06B01:C08 | MA125:C08 |
| 3374 | 9317 | I:1813409:03A01:C02 | MA111:C02 |
| 3375 | 9329 | I:1975514:03A01:A08 | MA111:A08 |
| 3376 | 9347 | I:1403294:01A01:B02 | MA103:B02 |
| 3377 | 9352 | I:2414624:01B01:D02 | MA105:D02 |
| 3378 | 9360 | I:2901811:01B01:H02 | MA105:H02 |
| 3379 | 9364 | I:2683564:01B01:B08 | MA105:B08 |
| 3380 | 9366 | I:2725511:01B01:C08 | MA105:C08 |
| 3381 | 9441 | I:1431273:04A01:A02 | MA115:A02 |

TABLE 31-continued

| SEQ ID NO | Spot ID | Clone ID | MAClone ID |
|---|---|---|---|
| 3382 | 9442 | I:1636639:04B01:A02 | MA117:A02 |
| 3383 | 9448 | I:2455617:04B01:D02 | MA117:D02 |
| 3384 | 9452 | I:2952504:04B01:F02 | MA117:F02 |
| 3385 | 9457 | I:1483847:04A01:A08 | MA115:A08 |
| 3386 | 9460 | I:2923150:04B01:B08 | MA117:B08 |
| 3387 | 9467 | I:1813133:04A01:F08 | MA115:F08 |
| 3388 | 9472 | I:2510171:04B01:H08 | MA117:H08 |
| 3389 | 9487 | I:2190284:02A01:H02 | MA107:H02 |
| 3390 | 9540 | I:1522716:05B02:B02 | MA122:B02 |
| 3391 | 9549 | I:1901271:05A02:G02 | MA120:G02 |
| 3392 | 9552 | I:1820522:05B02:H02 | MA122:H02 |
| 3393 | 9553 | I:2365295:05A02:A08 | MA120:A08 |
| 3394 | 9557 | I:1335140:05A02:C08 | MA120:C08 |
| 3395 | 9560 | I:1822577:05B02:D08 | MA122:D08 |
| 3396 | 9618 | I:1306814:06B02:A08 | MA126:A08 |
| 3397 | 9624 | I:3034694:06B02:D08 | MA126:D08 |
| 3398 | 9666 | I:1453049:03B02:A02 | MA114:A02 |
| 3399 | 9672 | I:1453748:03B02:D02 | MA114:D02 |
| 3400 | 9677 | I:3001492:03A02:G02 | MA112:G02 |
| 3401 | 9685 | I:3876715:03A02:C08 | MA112:C08 |
| 3402 | 9687 | I:2992851:03A02:D08 | MA112:D08 |
| 3403 | 9694 | I:1500649:03B02:G08 | MA114:G08 |
| 3404 | 9699 | I:1512943:01A02:B02 | MA104:B02 |
| 3405 | 9703 | I:1467565:01A02:D02 | MA104:D02 |
| 3406 | 9720 | I:2455118:01B02:D08 | MA106:D08 |
| 3407 | 9722 | I:2840251:01B02:E08 | MA106:E08 |
| 3408 | 9770 | I:2911347:10B02:E02 | MA67:E02 |
| 3409 | 9790 | I:1812030:10B02:G08 | MA67:G08 |
| 3410 | 9820 | I:2663606:04B02:F08 | MA118:F08 |
| 3411 | 9833 | I:1308333:02A02:E02 | MA108:E02 |
| 3412 | 9834 | I:1578941:02B02:E02 | MA110:E02 |
| 3413 | 9847 | I:1535439:02A02:D08 | MA108:D08 |
| 3414 | 9856 | I:1857475:02B02:H08 | MA110:H08 |
| 3415 | 9884 | I:2908878:08B01:F09 | MA133:F09 |
| 3416 | 9925 | I:2830575:07A01:C03 | MA127:C03 |
| 3417 | 9934 | I:1557906:07B01:G03 | MA129:G03 |
| 3418 | 9964 | I:2200604:06B01:F03 | MA125:F03 |
| 3419 | 9973 | I:1653326:06A01:C09 | MA123:C09 |
| 3420 | 9981 | I:1720149:06A01:G09 | MA123:G09 |
| 3421 | 10030 | I:1560987:03B01:G03 | MA113:G03 |
| 3422 | 10046 | I:1510714:03B01:G09 | MA113:G09 |
| 3423 | 10050 | I:2501484:01B01:A03 | MA105:A03 |
| 3424 | 10051 | I:1379063:01A01:B03 | MA103:B03 |
| 3425 | 10054 | I:2797902:01B01:C03 | MA105:C03 |
| 3426 | 10062 | I:1805613:01B01:G03 | MA105:G03 |
| 3427 | 10063 | I:1524885:01A01:H03 | MA103:H03 |
| 3428 | 10064 | I:2888464:01B01:H03 | MA105:H03 |
| 3429 | 10148 | I:1992788:04B01:B03 | MA117:B03 |
| 3430 | 10155 | I:1413451:04A01:F03 | MA115:F03 |
| 3431 | 10166 | I:2779515:04B01:C09 | MA117:C09 |
| 3432 | 10206 | I:1583076:02B01:G09 | MA109:G09 |
| 3433 | 10243 | I:3070110:05A02:B03 | MA120:B03 |
| 3434 | 10255 | I:1904493:05A02:H03 | MA120:H03 |
| 3435 | 10257 | I:2860815:05A02:A09 | MA120:A09 |
| 3436 | 10285 | I:1930135:07A02:G03 | MA128:G03 |
| 3437 | 10318 | I:3747901:06B02:G03 | MA126:G03 |
| 3438 | 10321 | I:1720946:06A02:A09 | MA124:A09 |
| 3439 | 10328 | I:2877413:06B02:D09 | MA126:D09 |
| 3440 | 10330 | I:3035279:06B02:E09 | MA126:E09 |
| 3441 | 10393 | I:2503913:03A02:E09 | MA112:E09 |
| 3442 | 10403 | I:1517380:01A02:B03 | MA104:B03 |
| 3443 | 10406 | I:3138128:01B02:C03 | MA106:C03 |
| 3444 | 10409 | I:2453722:01A02:E03 | MA104:E03 |
| 3445 | 10417 | I:1414260:01A02:A09 | MA104:A09 |
| 3446 | 10418 | I:2891247:01B02:A09 | MA106:A09 |
| 3447 | 10427 | I:1682176:01A02:F09 | MA104:F09 |
| 3448 | 10503 | I:2739076:04A02:D03 | MA116:D03 |
| 3449 | 10508 | I:1900378:04B02:F03 | MA118:F03 |
| 3450 | 10509 | I:1603391:04A02:G03 | MA116:G03 |
| 3451 | 10517 | I:2018222:04A02:C09 | MA116:C09 |
| 3452 | 10523 | I:1327263:04A02:F09 | MA116:F09 |
| 3453 | 10547 | I:1734393:02A02:B09 | MA108:B09 |
| 3454 | 10553 | I:2190607:02A02:E09 | MA108:E09 |
| 3455 | 10569 | I:2447969:08A01:E04 | MA131:E04 |
| 3456 | 10592 | I:1753033:08B01:H10 | MA133:H10 |
| 3457 | 10650 | I:2456393:07B01:E10 | MA129:E10 |
| 3458 | 10658 | I:1719920:06B01:A04 | MA125:A04 |
| 3459 | 10672 | I:2927362:06B01:H04 | MA125:H04 |
| 3460 | 10684 | I:4082816:06B01:F10 | MA125:F10 |
| 3461 | 10721 | I:1803446:03A01:A04 | MA111:A04 |
| 3462 | 10725 | I:1557490:03A01:C04 | MA111:C04 |
| 3463 | 10746 | I:1445895:03B01:E10 | MA113:E10 |
| 3464 | 10767 | I:1336836:01A01:H04 | MA103:H04 |
| 3465 | 10778 | I:1802745:01B01:E10 | MA105:E10 |
| 3466 | 10784 | I:2503003:01B01:H10 | MA105:H10 |
| 3467 | 10827 | I:1655377:10A01:F04 | MA64:F04 |
| 3468 | 10849 | I:1430662:04A01:A04 | MA115:A04 |
| 3469 | 10861 | I:3335055:04A01:G04 | MA115:G04 |
| 3470 | 10868 | I:2457671:04B01:B10 | MA117:B10 |
| 3471 | 10901 | I:1641421:02A01:C10 | MA107:C10 |
| 3472 | 10906 | I:1655225:02B01:E10 | MA109:E10 |
| 3473 | 10947 | I:1313325:05A02:B04 | MA120:B04 |
| 3474 | 10962 | I:1558081:05B02:A10 | MA122:A10 |
| 3475 | 10975 | I:1889191:05A02:H10 | MA120:H10 |
| 3476 | 10997 | I:3495906:07A02:C10 | MA128:C10 |
| 3477 | 11095 | I:3704132:03A02:D10 | MA112:D10 |
| 3478 | 11100 | I:1636553:03B02:F10 | MA114:F10 |
| 3479 | 11104 | I:1402228:03B02:H10 | MA114:H10 |
| 3480 | 11107 | I:1361963:01A02:B04 | MA104:B04 |
| 3481 | 11111 | I:1510424:01A02:D04 | MA104:D04 |
| 3482 | 11112 | I:2918558:01B02:D04 | MA106:D04 |
| 3483 | 11127 | I:1731061:01A02:D10 | MA104:D10 |
| 3484 | 11201 | I:2579602:04A02:A04 | MA116:A04 |
| 3485 | 11202 | I:2824181:04B02:A04 | MA118:A04 |
| 3486 | 11203 | I:2123183:04A02:B04 | MA116:B04 |
| 3487 | 11221 | I:1958560:04A02:C10 | MA116:C10 |
| 3488 | 11229 | I:1447903:04A02:G10 | MA116:G10 |
| 3489 | 11257 | I:1875576:02A02:E10 | MA108:E10 |
| 3490 | 11262 | I:1709457:02B02:G10 | MA110:G10 |
| 3491 | 11278 | I:2155675:08B01:G05 | MA133:G05 |
| 3492 | 11329 | I:1635069:07A01:A05 | MA127:A05 |
| 3493 | 11341 | I:1453445:07A01:G05 | MA127:G05 |
| 3494 | 11351 | I:3002566:07A01:D11 | MA127:D11 |
| 3495 | 11365 | I:1631511:06A01:C05 | MA123:C05 |
| 3496 | 11375 | I:1610523:06A01:H05 | MA123:H05 |
| 3497 | 11386 | I:3297656:06B01:E11 | MA125:E11 |
| 3498 | 11392 | I:2509730:06B01:H11 | MA125:H11 |
| 3499 | 11432 | I:2121863:03B01:D05 | MA113:D05 |
| 3500 | 11434 | I:1413704:03B01:E05 | MA113:E05 |
| 3501 | 11441 | I:1626232:03A01:A11 | MA111:A11 |
| 3502 | 11460 | I:2354446:01B01:B05 | MA105:B05 |
| 3503 | 11466 | I:2916753:01B01:E05 | MA105:E05 |
| 3504 | 11473 | I:2555034:01A01:A11 | MA103:A11 |
| 3505 | 11480 | I:2804190:01B01:D11 | MA105:D11 |
| 3506 | 11481 | I:1814488:01A01:E11 | MA103:E11 |
| 3507 | 11482 | I:2474163:01B01:E11 | MA105:E11 |
| 3508 | 11485 | I:1402967:01A01:G11 | MA103:G11 |
| 3509 | 11543 | I:2821541:10A01:D11 | MA64:D11 |
| 3510 | 11554 | I:2888814:04B01:A05 | MA117:A05 |
| 3511 | 11557 | I:1451005:04A01:C05 | MA115:C05 |
| 3512 | 11567 | I:1457726:04A01:H05 | MA115:H05 |
| 3513 | 11568 | I:2883195:04B01:H05 | MA117:H05 |
| 3514 | 11581 | I:1603605:04A01:G11 | MA115:G11 |
| 3515 | 11583 | I:2832224:04A01:H11 | MA115:H11 |
| 3516 | 11585 | I:2231364:02A01:A05 | MA107:A05 |
| 3517 | 11612 | I:1595081:02B01:F11 | MA109:F11 |
| 3518 | 11654 | I:1877913:05B02:C05 | MA122:C05 |
| 3519 | 11660 | I:1666130:05B02:F05 | MA122:F05 |
| 3520 | 11664 | I:1709995:05B02:H05 | MA122:H05 |
| 3521 | 11683 | I:3872557:07A02:B05 | MA128:B05 |
| 3522 | 11705 | I:2734906:07A02:E11 | MA128:E11 |
| 3523 | 11715 | I:1798585:06A02:B05 | MA124:B05 |
| 3524 | 11723 | I:1683389:06A02:F05 | MA124:F05 |
| 3525 | 11725 | I:1704517:06A02:G05 | MA124:G05 |
| 3526 | 11728 | I:2792982:06B02:H05 | MA126:H05 |
| 3527 | 11736 | I:3511355:06B02:D11 | MA126:D11 |
| 3528 | 11777 | I:1738060:03A02:A05 | MA112:A05 |
| 3529 | 11780 | I:1810821:03B02:B05 | MA114:B05 |
| 3530 | 11785 | I:2451279:03A02:E05 | MA112:E05 |
| 3531 | 11786 | I:1431166:03B02:E05 | MA114:E05 |
| 3532 | 11794 | I:2949427:03B02:A11 | MA114:A11 |
| 3533 | 11802 | I:1458366:03B02:E11 | MA114:E11 |
| 3534 | 11806 | I:1525881:03B02:G11 | MA114:G11 |
| 3535 | 11817 | I:2071473:01A02:E05 | MA104:E05 |

TABLE 31-continued

| SEQ ID NO | Spot ID | Clone ID | MAClone ID |
|---|---|---|---|
| 3536 | 11829 | I:2481012:01A02:C11 | MA104:C11 |
| 3537 | 11830 | I:2816931:01B02:C11 | MA106:C11 |
| 3538 | 11836 | I:1806769:01B02:F11 | MA106:F11 |
| 3539 | 11922 | I:2636634:04B02:A11 | MA118:A11 |
| 3540 | 11962 | I:1649959:02B02:E11 | MA110:E11 |
| 3541 | 11964 | I:1633719:02B02:F11 | MA110:F11 |
| 3542 | 11966 | I:1901035:02B02:G11 | MA110:G11 |
| 3543 | 11990 | I:2503879:08B01:C12 | MA133:C12 |
| 3544 | 12036 | I:2383065:07B01:B06 | MA129:B06 |
| 3545 | 12043 | I:3357245:07A01:F06 | MA127:F06 |
| 3546 | 12045 | I:2832314:07A01:G06 | MA127:G06 |
| 3547 | 12055 | I:3667096:07A01:D12 | MA127:D12 |
| 3548 | 12071 | I:1798283:06A01:D06 | MA123:D06 |
| 3549 | 12131 | I:1648206:03A01:B06 | MA111:B06 |
| 3550 | 12148 | I:3360476:03B01:B12 | MA113:B12 |
| 3551 | 12150 | I:2500511:03B01:C12 | MA113:C12 |
| 3552 | 12152 | I:1730806:03B01:D12 | MA113:D12 |
| 3553 | 12166 | I:2479074:01B01:C06 | MA105:C06 |
| 3554 | 12170 | I:1635004:01B01:E06 | MA105:E06 |
| 3555 | 12174 | I:2378569:01B01:G06 | MA105:G06 |
| 3556 | 12183 | I:2207849:01A01:D12 | MA103:D12 |
| 3557 | 12187 | I:1504554:01A01:F12 | MA103:F12 |
| 3558 | 12258 | I:2989991:04B01:A06 | MA117:A06 |
| 3559 | 12260 | I:2852561:04B01:B06 | MA117:B06 |
| 3560 | 12277 | I:2832839:04A01:C12 | MA115:C12 |
| 3561 | 12282 | I:2845548:04B01:E12 | MA117:E12 |
| 3562 | 12292 | I:1251819:02B01:B06 | MA109:B06 |
| 3563 | 12296 | I:1672930:02B01:D06 | MA109:D06 |
| 3564 | 12298 | I:2122820:02B01:E06 | MA109:E06 |
| 3565 | 12303 | I:2174920:02A01:H06 | MA107:H06 |
| 3566 | 12362 | I:1875994:05B02:E06 | MA122:E06 |
| 3567 | 12365 | I:1858644:05A02:G06 | MA120:G06 |
| 3568 | 12425 | I:1700047:06A02:E06 | MA124:E06 |
| 3569 | 12426 | I:1718257:06B02:E06 | MA126:E06 |
| 3570 | 12427 | I:1612306:06A02:F06 | MA124:F06 |
| 3571 | 12443 | I:1637427:06A02:F12 | MA124:F12 |
| 3572 | 12499 | I:2513883:03A02:B12 | MA112:B12 |
| 3573 | 12525 | I:2645840:01A02:G06 | MA104:G06 |
| 3574 | 12529 | I:1737403:01A02:A12 | MA104:A12 |
| 3575 | 12544 | I:1733522:01B02:H12 | MA106:H12 |
| 3576 | 17049 | RG:160664:10006:E07 | MA155:E07 |
| 3577 | 17065 | I:747335:16A01:E01 | MA87:E01 |
| 3578 | 17071 | I:2085191:16A01:H01 | MA87:H01 |
| 3579 | 17081 | I:1211126:16A01:E07 | MA87:E07 |
| 3580 | 17157 | RG:669310:10010:C01 | MA159:C01 |
| 3581 | 17167 | RG:730402:10010:H01 | MA159:H01 |
| 3582 | 17174 | RG:1047541:10012:C07 | MA161:C07 |
| 3583 | 17178 | RG:1161753:10012:E07 | MA161:E07 |
| 3584 | 17194 | I:1218464:17B01:E01 | MA93:E01 |
| 3585 | 17214 | I:958633:17B01:G07 | MA93:G07 |
| 3586 | 17236 | I:1602726:09B01:B07 | MA137:B07 |
| 3587 | 17379 | RG:205212:10007:B01 | MA156:B01 |
| 3588 | 17395 | RG:207395:10007:B07 | MA156:B07 |
| 3589 | 17422 | I:349535:16B02:G01 | MA90:G01 |
| 3590 | 17423 | I:2323525:16A02:H01 | MA88:H01 |
| 3591 | 17432 | I:1965049:16B02:D07 | MA90:D07 |
| 3592 | 17437 | I:2054436:16A02:G07 | MA88:G07 |
| 3593 | 17515 | RG:1506197:10013:F01 | MA162:F01 |
| 3594 | 17518 | RG:1871436:10015:G01 | MA164:G01 |
| 3595 | 17524 | RG:1705470:10015:B07 | MA164:B07 |
| 3596 | 17556 | I:546910:17B02:B07 | MA94:B07 |
| 3597 | 17580 | I:1799023:09B02:F01 | MA138:F01 |
| 3598 | 17584 | I:2380380:09B02:H01 | MA138:H01 |
| 3599 | 17675 | I:2319269:18A01:F02 | MA95:F02 |
| 3600 | 17687 | I:2296344:18A01:D08 | MA95:D08 |
| 3601 | 17737 | RG:155066:10006:E02 | MA155:E02 |
| 3602 | 17741 | RG:180135:10006:G02 | MA155:G02 |
| 3603 | 17755 | RG:178093:10006:F08 | MA155:F08 |
| 3604 | 17757 | RG:184042:10006:G08 | MA155:G08 |
| 3605 | 17761 | I:1741643:16A01:A02 | MA87:A02 |
| 3606 | 17860 | RG:928026:10012:B02 | MA161:B02 |
| 3607 | 17862 | RG:1032969:10012:C02 | MA161:C02 |
| 3608 | 17872 | RG:1322660:10012:H02 | MA161:H02 |
| 3609 | 17876 | RG:968474:10012:B08 | MA161:B08 |
| 3610 | 17878 | RG:1047592:10012:C08 | MA161:C08 |
| 3611 | 17914 | I:617750:17B01:E08 | MA93:E08 |
| 3612 | 17934 | I:2808775:09B01:G02 | MA137:G02 |
| 3613 | 18035 | I:966692:18A02:B08 | MA96:B08 |
| 3614 | 18085 | RG:209240:10007:C02 | MA156:C02 |
| 3615 | 18087 | RG:223355:10007:D02 | MA156:D02 |
| 3616 | 18095 | RG:267629:10007:H02 | MA156:H02 |
| 3617 | 18134 | I:2246234:16B02:C08 | MA90:C08 |
| 3618 | 18212 | RG:1696513:10015:B02 | MA164:B02 |
| 3619 | 18216 | RG:1733895:10015:D02 | MA164:D02 |
| 3620 | 18225 | RG:1353930:10013:A08 | MA162:A08 |
| 3621 | 18238 | RG:1881947:10015:G08 | MA164:G08 |
| 3622 | 18443 | RG:166575:10006:F03 | MA155:F03 |
| 3623 | 18465 | I:1998994:16A01:A03 | MA87:A03 |
| 3624 | 18471 | I:1953051:16A01:D03 | MA87:D03 |
| 3625 | 18473 | I:518826:16A01:E03 | MA87:E03 |
| 3626 | 18483 | I:81490:16A01:B09 | MA87:B09 |
| 3627 | 18572 | RG:1256163:10012:F03 | MA161:F03 |
| 3628 | 18584 | RG:1132085:10012:D09 | MA161:D09 |
| 3629 | 18614 | I:2132717:17B01:C09 | MA93:C09 |
| 3630 | 18620 | I:1998428:17B01:F09 | MA93:F09 |
| 3631 | 18787 | RG:206694:10007:B03 | MA156:B03 |
| 3632 | 18811 | RG:261714:10007:F09 | MA156:F09 |
| 3633 | 18821 | I:1461515:16A02:C03 | MA88:C03 |
| 3634 | 18831 | I:338859:16A02:H03 | MA88:H03 |
| 3635 | 18845 | I:1425861:16A02:G09 | MA88:G09 |
| 3636 | 18848 | I:1928644:16B02:H09 | MA90:H09 |
| 3637 | 18917 | RG:1404414:10013:C03 | MA162:C03 |
| 3638 | 18919 | RG:1415437:10013:D03 | MA162:D03 |
| 3639 | 18920 | RG:1734353:10015:D03 | MA164:D03 |
| 3640 | 18926 | RG:1872251:10015:G03 | MA164:G03 |
| 3641 | 18929 | RG:1354408:10013:A09 | MA162:A09 |
| 3642 | 18930 | RG:1690198:10015:A09 | MA164:A09 |
| 3643 | 18937 | RG:1476452:10013:E09 | MA162:E09 |
| 3644 | 18988 | I:2069305:09B02:F03 | MA138:F03 |
| 3645 | 19088 | I:1966067:18B01:H04 | MA97:H04 |
| 3646 | 19090 | I:2128547:18B01:A10 | MA97:A10 |
| 3647 | 19143 | RG:149960:10006:D04 | MA155:D04 |
| 3648 | 19147 | RG:171569:10006:F04 | MA155:F04 |
| 3649 | 19163 | RG:178638:10006:F10 | MA155:F10 |
| 3650 | 19167 | RG:195122:10006:H10 | MA155:H10 |
| 3651 | 19195 | I:814216:16A01:F10 | MA87:F10 |
| 3652 | 19265 | RG:491163:10010:A04 | MA159:A04 |
| 3653 | 19266 | RG:827185:10012:A04 | MA161:A04 |
| 3654 | 19272 | RG:1129102:10012:D04 | MA161:D04 |
| 3655 | 19279 | RG:730938:10010:H04 | MA159:H04 |
| 3656 | 19282 | RG:925984:10012:A10 | MA161:A10 |
| 3657 | 19283 | RG:668442:10010:B10 | MA159:B10 |
| 3658 | 19284 | RG:1028911:10012:B10 | MA161:B10 |
| 3659 | 19285 | RG:684866:10010:C10 | MA159:C10 |
| 3660 | 19292 | RG:1283076:10012:F10 | MA161:F10 |
| 3661 | 19309 | I:627654:17A01:G04 | MA91:G04 |
| 3662 | 19319 | I:1833801:17A01:D10 | MA91:D10 |
| 3663 | 19328 | I:961473:17B01:H10 | MA93:H10 |
| 3664 | 19348 | I:2556708:09B01:B10 | MA137:B10 |
| 3665 | 19511 | RG:243565:10007:D10 | MA156:D10 |
| 3666 | 19517 | RG:266649:10007:G10 | MA156:G10 |
| 3667 | 19524 | I:2013513:16B02:B04 | MA90:B04 |
| 3668 | 19539 | I:2312442:16A02:B10 | MA88:B10 |
| 3669 | 19543 | I:2060626:16A02:D10 | MA88:D10 |
| 3670 | 19623 | RG:1415858:10013:D04 | MA162:D04 |
| 3671 | 19627 | RG:1517435:10013:F04 | MA162:F04 |
| 3672 | 19632 | RG:1914716:10015:H04 | MA164:H04 |
| 3673 | 19633 | RG:1354528:10013:A10 | MA162:A10 |
| 3674 | 19636 | RG:1706414:10015:310 | MA164:B10 |
| 3675 | 19653 | I:1998510:17A02:C04 | MA92:C04 |
| 3676 | 19678 | I:899118:17B02:G10 | MA94:G10 |
| 3677 | 19684 | I:2680168:09B02:B04 | MA138:B04 |
| 3678 | 19690 | I:1354558:09B02:E04 | MA138:E04 |
| 3679 | 19708 | I:1665871:09B02:F10 | MA138:F10 |
| 3680 | 19782 | I:1922084:18B01:C05 | MA97:C05 |
| 3681 | 19795 | I:2307946:18A01:B11 | MA95:B11 |
| 3682 | 19798 | I:1923572:18B01:C11 | MA97:C11 |
| 3683 | 19851 | RG:171993:10006:F05 | MA155:F05 |
| 3684 | 19859 | RG:129317:10006:B11 | MA155:B11 |
| 3685 | 19863 | RG:153244:10006:D11 | MA155:D11 |
| 3686 | 19871 | RG:196236:10006:H11 | MA155:H11 |
| 3687 | 19893 | I:557538:16A01:C11 | MA87:C11 |
| 3688 | 19899 | I:782235:16A01:F11 | MA87:F11 |
| 3689 | 19980 | RG:1257341:10012:F05 | MA161:F05 |

TABLE 31-continued

| SEQ ID NO | Spot ID | Clone ID | MAClone ID |
|---|---|---|---|
| 3690 | 19981 | RG:727387:10010:G05 | MA159:G05 |
| 3691 | 19992 | RG:1145235:10012:D11 | MA161:D11 |
| 3692 | 19995 | RG:725145:10010:F11 | MA159:F11 |
| 3693 | 19999 | RG:740079:10010:H11 | MA159:H11 |
| 3694 | 20042 | I:1873176:09B01:E05 | MA137:E05 |
| 3695 | 20056 | I:2081974:09B01:D11 | MA137:D11 |
| 3696 | 20141 | I:2107723:18A02:G05 | MA96:G05 |
| 3697 | 20211 | RG:207777:10007:B11 | MA156:B11 |
| 3698 | 20213 | RG:221172:10007:C11 | MA156:C11 |
| 3699 | 20230 | I:1968436:16B02:C05 | MA90:C05 |
| 3700 | 20253 | I:2060973:16A02:G11 | MA88:G11 |
| 3701 | 20323 | RG:1369494:10013:B05 | MA162:B05 |
| 3702 | 20330 | RG:1752177:10015:E05 | MA164:E05 |
| 3703 | 20331 | RG:1519327:10013:F05 | MA162:F05 |
| 3704 | 20338 | RG:1694569:10015:A11 | MA164:A11 |
| 3705 | 20346 | RG:1839794:10015:E11 | MA164:E11 |
| 3706 | 20359 | I:514124:17A02:D05 | MA92:D05 |
| 3707 | 20365 | I:997782:17A02:G05 | MA92:G05 |
| 3708 | 20412 | I:1709364:09B02:F11 | MA138:F11 |
| 3709 | 20485 | I:2004896:18A01:C06 | MA95:C06 |
| 3710 | 20555 | RG:172982:10006:F06 | MA155:F06 |
| 3711 | 20557 | RG:180978:10006:G06 | MA155:G06 |
| 3712 | 20563 | RG:129528:10006:B12 | MA155:B12 |
| 3713 | 20573 | RG:186511:10006:G12 | MA155:G12 |
| 3714 | 20580 | I:2005910:16B01:B06 | MA89:B06 |
| 3715 | 20583 | I:620871:16A01:D06 | MA87:D06 |
| 3716 | 20593 | I:1920819:16A01:A12 | MA87:A12 |
| 3717 | 20601 | I:990375:16A01:E12 | MA87:E12 |
| 3718 | 20605 | I:690313:16A01:G12 | MA87:G12 |
| 3719 | 20674 | RG:878195:10012:A06 | MA161:A06 |
| 3720 | 20679 | RG:687128:10010:D06 | MA159:D06 |
| 3721 | 20712 | I:884855:17B01:D06 | MA93:D06 |
| 3722 | 20716 | I:1218621:17B01:F06 | MA93:F06 |
| 3723 | 20719 | I:620371:17A01:H06 | MA91:H06 |
| 3724 | 20744 | I:1681610:09B01:D06 | MA137:D06 |
| 3725 | 20909 | RG:265206:10007:G06 | MA156:G06 |
| 3726 | 20911 | RG:268073:10007:H06 | MA156:H06 |
| 3727 | 20939 | I:2117221:16A02:F06 | MA88:F06 |
| 3728 | 20942 | I:1760693:16B02:G06 | MA90:G06 |
| 3729 | 20948 | I:776793:16B02:B12 | MA90:B12 |
| 3730 | 21029 | RG:1405692:10013:C06 | MA162:C06 |
| 3731 | 21044 | RG:1707747:10015:B12 | MA164:B12 |
| 3732 | 21046 | RG:1722789:10015:C12 | MA164:C12 |
| 3733 | 21066 | I:2112348:17B02:E06 | MA94:E06 |
| 3734 | 21067 | I:630458:17A02:F06 | MA92:F06 |
| 3735 | 21071 | I:901577:17A02:H06 | MA92:H06 |
| 3736 | 21082 | I:2298081:17B02:E12 | MA94:E12 |
| 3737 | 21120 | I:2718565:09B02:H12 | MA138:H12 |
| 3738 | 21122 | M00056237C:E03 | MA181:A01 |
| 3739 | 21130 | M00055261C:F04 | MA197:E01 |
| 3740 | 21144 | M00055353D:A04 | MA197:D07 |
| 3741 | 21152 | M00055357B:B10 | MA197:H07 |
| 3742 | 21189 | M00056386D:H12 | MA173:C01 |
| 3743 | 21191 | M00056394B:B04 | MA173:D01 |
| 3744 | 21193 | M00056395A:B04 | MA173:E01 |
| 3745 | 21195 | M00056396B:G05 | MA173:F01 |
| 3746 | 21198 | M00056137A:A05 | MA180:G01 |
| 3747 | 21199 | M00056401C:C03 | MA173:H01 |
| 3748 | 21209 | M00056484A:F06 | MA173:E07 |
| 3749 | 21212 | M00056193B:C11 | MA180:F07 |
| 3750 | 21213 | M00056484B:B07 | MA173:G07 |
| 3751 | 21214 | M00056193D:D06 | MA180:G07 |
| 3752 | 21216 | M00056194B:G06 | MA180:H07 |
| 3753 | 21217 | M00054633D:B07 | MA187:A01 |
| 3754 | 21219 | M00054633D:E06 | MA187:B01 |
| 3755 | 21232 | M00054848A:C03 | MA189:H01 |
| 3756 | 21234 | M00054882C:C06 | MA189:A07 |
| 3757 | 21237 | M00054678D:A03 | MA187:C07 |
| 3758 | 21239 | M00054679B:B03 | MA187:D07 |
| 3759 | 21245 | M00054680B:D06 | MA187:G07 |
| 3760 | 21247 | M00054680C:A06 | MA187:H07 |
| 3761 | 21252 | M00057176B:F11 | MA193:B01 |
| 3762 | 21254 | M00057181A:D01 | MA193:C01 |
| 3763 | 21272 | M00057219D:B04 | MA193:D07 |
| 3764 | 21281 | M00042341A:D12 | MA167:A01 |
| 3765 | 21284 | M00042433B:G09 | MA171:B01 |
| 3766 | 21288 | M00042435A:F08 | MA171:D01 |
| 3767 | 21290 | M00042437B:G03 | MA171:E01 |
| 3768 | 21291 | M00042525D:E07 | MA167:F01 |
| 3769 | 21292 | M00042438B:D01 | MA171:F01 |
| 3770 | 21293 | M00042529C:G07 | MA167:G01 |
| 3771 | 21295 | M00042529D:B12 | MA167:H01 |
| 3772 | 21297 | M00042700A:E05 | MA167:A07 |
| 3773 | 21300 | M00042777D:G05 | MA171:B07 |
| 3774 | 21304 | M00042781C:F03 | MA171:D07 |
| 3775 | 21306 | M00042783C:F10 | MA171:E07 |
| 3776 | 21307 | M00042702D:B02 | MA167:F07 |
| 3777 | 21312 | M00042785B:F11 | MA171:H07 |
| 3778 | 21329 | M00056566C:C03 | MA174:A07 |
| 3779 | 21333 | M00056567B:A09 | MA174:C07 |
| 3780 | 21341 | M00056569B:D09 | MA174:G07 |
| 3781 | 21343 | M00056571D:E05 | MA174:H07 |
| 3782 | 21349 | RG:376801:10009:C01 | MA158:C01 |
| 3783 | 21363 | RG:365436:10009:B07 | MA158:B07 |
| 3784 | 21367 | RG:416839:10009:D07 | MA158:D07 |
| 3785 | 21370 | RG:784224:10011:E07 | MA160:E07 |
| 3786 | 21374 | RG:796852:10011:G07 | MA160:G07 |
| 3787 | 21386 | M00043412A:F04 | MA184:E01 |
| 3788 | 21391 | M00055273B:H10 | MA182:H01 |
| 3789 | 21396 | M00054506C:B10 | MA184:B07 |
| 3790 | 21404 | M00054507D:G03 | MA184:F07 |
| 3791 | 21418 | M00054935B:B03 | MA198:E01 |
| 3792 | 21424 | M00054935D:C11 | MA198:H01 |
| 3793 | 21432 | M00054976A:E09 | MA198:D07 |
| 3794 | 21461 | M00055788B:F08 | MA170:C07 |
| 3795 | 21469 | M00055791A:E10 | MA170:G07 |
| 3796 | 21497 | M00055224C:H11 | MA196:E07 |
| 3797 | 21539 | M00055932A:C02 | MA179:B01 |
| 3798 | 21542 | M00056908A:F12 | MA177:C01 |
| 3799 | 21543 | M00055935D:B06 | MA179:D01 |
| 3800 | 21546 | M00056908D:D08 | MA177:E01 |
| 3801 | 21547 | M00055942B:F08 | MA179:F01 |
| 3802 | 21550 | M00056910A:B07 | MA177:G01 |
| 3803 | 21568 | M00056952B:C08 | MA177:H07 |
| 3804 | 21569 | M00054728C:E03 | MA188:A01 |
| 3805 | 21571 | M00054728D:b06 | MA188:B01 |
| 3806 | 21583 | M00054731C:H01 | MA188:H01 |
| 3807 | 21591 | M00054778B:A12 | MA188:D07 |
| 3808 | 21595 | M00054778C:D08 | MA188:F07 |
| 3809 | 21599 | M00054780A:G06 | MA188:H07 |
| 3810 | 21633 | M00042899D:D02 | MA168:A01 |
| 3811 | 21638 | M00042831B:G10 | MA172:C01 |
| 3812 | 21640 | M00042833A:G07 | MA172:D01 |
| 3813 | 21641 | M00042906D:F05 | MA168:E01 |
| 3814 | 21645 | M00042910C:A02 | MA168:G01 |
| 3815 | 21648 | M00042838C:D06 | MA172:H01 |
| 3816 | 21650 | M00042867B:F03 | MA172:A07 |
| 3817 | 21651 | M00055439B:G05 | MA168:B07 |
| 3818 | 21659 | M00055442D:E12 | MA168:F07 |
| 3819 | 21667 | M00056711D:A02 | MA175:B01 |
| 3820 | 21681 | M00056771C:A12 | MA175:A07 |
| 3821 | 21685 | M00056772D:G07 | MA175:C07 |
| 3822 | 21691 | M00056782D:E04 | MA175:F07 |
| 3823 | 21693 | M00056785D:G01 | MA175:G07 |
| 3824 | 21695 | M00056788C:A01 | MA175:H07 |
| 3825 | 21723 | RG:1663880:10014:F07 | MA163:F07 |
| 3826 | 21733 | M00043310B:D08 | MA183:C01 |
| 3827 | 21734 | M00054538C:G03 | MA185:C01 |
| 3828 | 21743 | M00043315C:G05 | MA183:H01 |
| 3829 | 21764 | M00055397B:E08 | MA199:B01 |
| 3830 | 21765 | M00056624B:H11 | MA186:C01 |
| 3831 | 21786 | M00055423C:C03 | MA199:E07 |
| 3832 | 21787 | M00056668D:C06 | MA186:F07 |
| 3833 | 21789 | M000566698:A10 | MA186:G07 |
| 3834 | 21790 | M00055424A:D01 | MA199:G07 |
| 3835 | 21791 | M00056669B:E07 | MA186:H07 |
| 3836 | 21792 | M00055424D:F01 | MA199:H07 |
| 3837 | 21798 | M00056243A:H07 | MA181:C02 |
| 3838 | 21800 | M00056243C:G10 | MA181:D02 |
| 3839 | 21803 | M00055528D:H03 | MA169:F02 |
| 3840 | 21811 | M00055607B:A11 | MA169:B08 |
| 3841 | 21842 | M00055363C:E02 | MA197:A08 |
| 3842 | 21852 | M00055373D:H02 | MA197:F08 |
| 3843 | 21856 | M00055374D:E01 | MA197:H08 |

TABLE 31-continued

| SEQ ID NO | Spot ID | Clone ID | MAClone ID |
|---|---|---|---|
| 3844 | 21889 | M00056401D:D09 | MA173:A02 |
| 3845 | 21892 | M00056139D:A10 | MA180:B02 |
| 3846 | 21896 | M00056140A:E11 | MA180:D02 |
| 3847 | 21898 | M00056142D:A08 | MA180:E02 |
| 3848 | 21899 | M00056412D:A09 | MA173:F02 |
| 3849 | 21900 | M00056142D:H11 | MA180:F02 |
| 3850 | 21901 | M00056414C:F03 | MA173:G02 |
| 3851 | 21908 | M00056196A:H09 | MA180:B08 |
| 3852 | 21912 | M00056200A:E11 | MA180:D08 |
| 3853 | 21913 | M00056488C:G01 | MA173:E08 |
| 3854 | 21914 | M00056200B:B01 | MA180:E08 |
| 3855 | 21916 | M00056203B:G08 | MA180:F08 |
| 3856 | 21919 | M00056493A:F09 | MA173:H08 |
| 3857 | 21923 | M00056640D:D12 | MA187:B02 |
| 3858 | 11927 | M00054643B:F04 | MA187:D02 |
| 3859 | 21929 | M00054643B:D08 | MA187:E02 |
| 3860 | 21932 | M00054854B:B06 | MA189:F02 |
| 3861 | 21933 | M00054644B:F02 | MA187:G02 |
| 3862 | 21934 | M00054857A:E08 | MA189:G02 |
| 3863 | 21939 | M00054681D:G03 | MA187:B08 |
| 3864 | 21943 | M00054682D:F11 | MA187:D08 |
| 3865 | 21947 | M00054684B:C07 | MA197:F08 |
| 3866 | 21960 | M00057191B:E11 | MA193:D02 |
| 3867 | 21966 | M00057194B:G12 | MA193:G02 |
| 3868 | 21972 | M00057222D:G09 | MA193:B08 |
| 3869 | 21985 | M00042531B:H03 | MA167:A02 |
| 3870 | 21986 | M00042440C:G04 | MA171:A02 |
| 3871 | 21989 | M00042533C:D02 | MA167:C02 |
| 3872 | 21993 | M00042536D:H05 | MA167:E02 |
| 3873 | 21994 | M00042465B:E04 | MA171:E02 |
| 3874 | 21995 | M00042537D:F10 | MA167:F02 |
| 3875 | 21996 | M00042467B:B04 | MA171:F02 |
| 3876 | 21997 | M00042538D:D12 | MA167:G02 |
| 3877 | 21998 | M00042467B:B08 | MA171:G02 |
| 3878 | 22003 | M00042711B:G09 | MA167:B08 |
| 3879 | 22004 | M00042790D:E12 | MA171:B08 |
| 3880 | 22006 | M00042791A:C10 | MA171:C08 |
| 3881 | 22007 | M00042711C:H05 | MA167:D08 |
| 3882 | 22016 | M00042801D:B02 | MA171:H08 |
| 3883 | 22016 | M00042801D:B02 | MA171:H08 |
| 3884 | 22021 | M00056532A:D09 | MA174:C02 |
| 3885 | 22025 | M00056533D:H04 | MA174:E02 |
| 3886 | 22035 | M00056575B:C04 | MA174:B08 |
| 3887 | 22037 | M00056578C:A09 | MA174:C08 |
| 3888 | 22044 | RG:1862465:20001:D08 | MA139:D08 |
| 3889 | 22044 | RG:1862465:20001:F08 | MA139:F08 |
| 3890 | 22049 | RG:347381:10009:A02 | MA158:A02 |
| 3891 | 22071 | RG:417093:10009:D08 | MA158:D08 |
| 3892 | 22082 | M00043413B:C04 | MA184:A02 |
| 3893 | 22092 | M00043502D:C12 | MA184:F02 |
| 3894 | 22105 | M00057341B:B11 | MA182:E08 |
| 3895 | 22110 | M00054512A:F11 | MA184:G08 |
| 3896 | 22111 | M00042353A:D05 | MA182:H08 |
| 3897 | 22116 | M00054937B:D09 | MA198:B02 |
| 3898 | 22167 | M00055797C:H09 | MA170:D08 |
| 3899 | 22169 | M00055799B:C01 | MA170:E08 |
| 3900 | 22183 | M00055194C:G12 | MA196:D02 |
| 3901 | 22195 | M00055233B:D08 | MA196:B08 |
| 3902 | 22255 | M00055966C:D06 | MA179:H02 |
| 3903 | 22263 | M00056024B:B06 | MA179:D08 |
| 3904 | 22265 | M00056024C:G04 | MA179:E08 |
| 3905 | 22279 | M00054737D:F10 | MA188:D02 |
| 3906 | 22289 | M00054780D:C09 | MA188:A08 |
| 3907 | 22295 | M00054787A:E09 | MA188:D08 |
| 3908 | 22297 | M00054806C:E11 | MA188:E08 |
| 3909 | 22339 | M00042913B:C11 | MA168:B02 |
| 3910 | 22343 | M00042915B:B10 | MA168:D02 |
| 3911 | 22345 | M00054792C:E12 | MA168:E02 |
| 3912 | 22350 | M00042842A:C01 | MA172:G02 |
| 3913 | 22367 | M00055450A:C09 | MA168:H08 |
| 3914 | 22399 | M00056804C:D01 | MA175:H08 |
| 3915 | 22423 | RG:1647954:10014:D08 | MA163:D08 |
| 3916 | 22427 | RG:1664311:10014:F08 | MA163:F08 |
| 3917 | 22429 | RG:1671377:10014:G08 | MA163:G08 |
| 3918 | 22437 | M00043316B:F10 | MA183:C02 |
| 3919 | 22440 | M00054545B:A03 | MA185:D02 |
| 3920 | 22442 | M00054545B:B09 | MA185:E02 |
| 3921 | 22456 | M00054575A:B09 | MA185:D08 |
| 3922 | 22459 | M00043374B:H05 | MA183:F08 |
| 3923 | 22475 | M00056641A:G11 | MA186:F02 |
| 3924 | 22479 | M00056642A:D08 | MA186:H02 |
| 3925 | 22480 | M00055403B:B11 | MA199:H02 |
| 3926 | 22495 | M00056676B:C11 | MA186:H08 |
| 3927 | 22499 | M00055530D:B02 | MA169:B03 |
| 3928 | 22502 | M00056253A:D06 | MA181:C03 |
| 3929 | 22504 | M00056253B:B06 | MA181:D03 |
| 3930 | 22519 | M00055642D:F09 | MA169:D09 |
| 3931 | 22521 | M00055643A:E09 | MA169:E09 |
| 3932 | 22523 | M00055643D:E02 | MA169:F09 |
| 3933 | 22548 | M00055376D:D08 | MA197:B09 |
| 3934 | 22595 | M00056415C:D02 | MA173:B03 |
| 3935 | 22596 | M00056146D:F05 | MA180:B03 |
| 3936 | 22597 | M00056417A:F02 | MA173:C03 |
| 3937 | 22598 | M00056148A:B07 | MA180:C03 |
| 3938 | 22599 | M00056420C:E07 | MA173:D03 |
| 3939 | 22600 | M00056150A:E04 | MA180:D03 |
| 3940 | 22603 | M00056421C:H11 | MA173:F03 |
| 3941 | 22604 | M00056150C:A10 | MA180:F03 |
| 3942 | 22605 | M00056421D:H05 | MA173:G03 |
| 3943 | 22606 | M00056150C:C04 | MA180:G03 |
| 3944 | 22607 | M00056422B:D11 | MA173:H03 |
| 3945 | 22608 | M00056151C:A12 | MA180:H03 |
| 3946 | 22609 | M00056493C:E06 | MA173:A09 |
| 3947 | 22610 | M00056205D:E03 | MA180:A09 |
| 3948 | 22611 | M00056495A:G10 | MA173:B09 |
| 3949 | 22618 | M00056206D:B10 | MA180:E09 |
| 3950 | 22623 | M00056501D:C08 | MA173:H09 |
| 3951 | 22624 | M00056209D:H10 | MA180:H09 |
| 3952 | 22627 | M00054645B:C12 | MA187:B03 |
| 3953 | 22629 | M00054646A:B10 | MA187:C03 |
| 3954 | 22637 | M00054647D:E01 | MA187:G03 |
| 3955 | 22666 | M00057202C:G06 | MA193:E03 |
| 3956 | 22668 | M00057202D:C11 | MA193:F03 |
| 3957 | 22693 | M00042549A:G12 | MA167:C03 |
| 3958 | 22695 | M00042549D:F03 | MA167:D03 |
| 3959 | 22697 | M00042551B:D12 | MA167:E03 |
| 3960 | 22698 | M00042513A:D03 | MA171:E03 |
| 3961 | 22700 | M00042513D:A12 | MA171:F03 |
| 3962 | 22703 | M00042551D:D12 | MA167:H03 |
| 3963 | 22705 | M00042717B:D05 | MA167:A09 |
| 3964 | 22707 | M00042719D:C09 | MA167:B09 |
| 3965 | 22710 | M00042803C:F11 | MA171:C09 |
| 3966 | 22714 | M00042805D:D12 | MA171:E09 |
| 3967 | 22715 | M00042731A:G04 | MA167:F09 |
| 3968 | 22718 | M00042806C:E09 | MA171:G09 |
| 3969 | 22720 | M00042806D:F08 | MA171:H09 |
| 3970 | 22725 | M00056537A:F05 | MA174:C03 |
| 3971 | 22727 | M00056537D:A07 | MA174:D03 |
| 3972 | 22734 | RG:1862584:20001:G03 | MA139:G03 |
| 3973 | 22737 | M00056585D:D05 | MA174:A09 |
| 3974 | 22739 | M00056586C:B08 | MA174:B09 |
| 3975 | 22745 | M00056592A:B08 | MA174:E09 |
| 3976 | 22757 | RG:378550:10009:C03 | MA158:C03 |
| 3977 | 22780 | RG:789040:10011:F09 | MA160:F09 |
| 3978 | 22787 | M00057283A:D01 | MA182:B03 |
| 3979 | 22792 | M00043505A:E07 | MA184:D03 |
| 3980 | 22798 | M00043506B:G10 | MA184:G03 |
| 3981 | 22800 | M00043507A:B02 | MA184:H03 |
| 3982 | 22801 | M00042353C:F02 | MA182:A09 |
| 3983 | 22812 | M00054516B:A08 | MA184:F09 |
| 3984 | 22834 | M00054986D:B04 | MA198:A09 |
| 3985 | 22836 | M00054987C:B10 | MA198:B09 |
| 3986 | 22838 | M00054988D:B11 | MA198:C09 |
| 3987 | 22857 | M00055743C:G08 | MA170:E03 |
| 3988 | 22887 | M00055196B:C09 | MA196:D03 |
| 3989 | 22899 | M00055238B:G05 | MA196:B09 |
| 3990 | 22910 | M00056207B:H06 | MA180:G09 |
| 3991 | 22945 | M00055966C:G04 | MA179:A03 |
| 3992 | 22946 | M00056920D:C08 | MA177:A03 |
| 3993 | 22949 | M00055969D:D01 | MA179:C03 |
| 3994 | 22969 | M00056055D:F06 | MA179:E09 |
| 3995 | 22970 | M00056956B:G12 | MA177:E09 |
| 3996 | 22971 | M00056060D:C04 | MA179:F09 |
| 3997 | 22973 | M00056061C:H04 | MA179:G09 |

TABLE 31-continued

| SEQ ID NO | Spot ID | Clone ID | MAClone ID |
|---|---|---|---|
| 3998 | 22977 | M00054743C:E05 | MA188:A03 |
| 3999 | 22979 | M00054744C:B02 | MA188:B03 |
| 4000 | 22997 | M00054808A:E02 | MA188:C09 |
| 4001 | 23005 | M00054811A:G01 | MA188:G09 |
| 4002 | 23041 | M00054797C:G10 | MA168:A03 |
| 4003 | 23042 | M00042843B:H01 | MA172:A03 |
| 4004 | 23048 | M00042844D:D10 | MA172:D03 |
| 4005 | 23050 | M00042845D:A12 | MA172:E03 |
| 4006 | 23053 | M00054800C:H10 | MA168:G03 |
| 4007 | 23055 | M00054911D:E09 | MA168:H03 |
| 4008 | 23057 | M00055450A:G03 | MA168:A09 |
| 4009 | 23063 | M00055456B:H05 | MA168:D09 |
| 4010 | 23079 | M00056733C:D03 | MA175:D03 |
| 4011 | 23087 | M00056737D:E08 | MA175:H03 |
| 4012 | 23097 | M00056809B:A12 | MA175:E09 |
| 4013 | 23101 | M00056809D:C07 | MA175:G09 |
| 4014 | 23131 | RG:1664308:10014:F09 | MA163:F09 |
| 4015 | 23139 | M00043321A:G07 | MA183:B03 |
| 4016 | 23142 | M00054549A:F03 | MA185:C03 |
| 4017 | 23159 | M00043381A:C08 | MA183:D09 |
| 4018 | 23169 | M00056642B:G03 | MA186:A03 |
| 4019 | 23199 | M00056688C:A07 | MA186:H09 |
| 4020 | 23202 | M00056257C:G03 | MA181:A04 |
| 4021 | 23213 | M00055545C:F11 | MA169:G04 |
| 4022 | 23221 | M00055653C:F04 | MA169:C10 |
| 4023 | 23223 | M00055653D:F01 | MA169:D10 |
| 4024 | 23252 | M00055385A:C11 | MA197:B10 |
| 4025 | 23304 | M00056157A:F11 | MA180:D04 |
| 4026 | 23306 | M00056160A:F03 | MA180:E04 |
| 4027 | 23307 | M00056426A:H07 | MA173:F04 |
| 4028 | 23318 | M00056214C:B04 | MA180:C10 |
| 4029 | 23320 | M00056216A:F10 | MA180:D10 |
| 4030 | 23325 | M00056507A:G11 | MA173:G10 |
| 4031 | 23329 | M00054648C:C10 | MA187:A04 |
| 4032 | 23330 | M00054862A:H11 | MA189:A04 |
| 4033 | 23331 | M00054648D:F12 | MA187:B04 |
| 4034 | 23335 | M00054650A:H08 | MA187:D04 |
| 4035 | 23344 | M00054868C:C11 | MA189:H04 |
| 4036 | 23351 | M00054700C:E02 | MA187:D10 |
| 4037 | 23356 | M00054902D:G11 | MA189:F10 |
| 4038 | 23358 | M00054903B:G06 | MA189:G10 |
| 4039 | 23359 | M00054706A:D05 | MA187:H10 |
| 4040 | 23366 | M00057207A:D05 | MA193:C04 |
| 4041 | 23368 | M00057207C:F06 | MA193:D04 |
| 4042 | 23372 | M00057208B:F11 | MA193:F04 |
| 4043 | 23382 | M00057242B:B10 | MA193:C10 |
| 4044 | 23397 | M00042555A:E06 | MA167:C04 |
| 4045 | 23399 | M00042561A:H03 | MA167:D04 |
| 4046 | 23402 | M00042756C:E10 | MA171:E04 |
| 4047 | 23404 | M00042758D:F01 | MA171:F04 |
| 4048 | 23408 | M00042759B:E02 | MA171:H04 |
| 4049 | 23412 | M00042808D:D03 | MA171:B10 |
| 4050 | 23414 | M00042808D:D10 | MA171:C10 |
| 4051 | 23416 | M00042811B:A05 | MA171:D10 |
| 4052 | 23417 | M00042746B:F05 | MA167:E10 |
| 4053 | 23421 | M00042746C:D01 | MA167:G10 |
| 4054 | 23422 | M00042812D:B04 | MA171:G10 |
| 4055 | 23425 | M00056546B:F12 | MA174:A04 |
| 4056 | 23439 | M00056550A:G09 | MA174:H04 |
| 4057 | 23453 | M00056610C:B08 | MA174:G10 |
| 4058 | 23460 | RG:745556:10011:B04 | MA160:B04 |
| 4059 | 23469 | RG:446537:10009:G04 | MA158:G04 |
| 4060 | 23475 | RG:375937:10009:B10 | MA158:B10 |
| 4061 | 23476 | RG:755120:10011:B10 | MA160:B10 |
| 4062 | 23480 | RG:781108:10011:D10 | MA160:D10 |
| 4063 | 23505 | M00042450C:H10 | MA182:A10 |
| 4064 | 23507 | M00042451B:B05 | MA182:B10 |
| 4065 | 23508 | M00054517D:D12 | MA184:B10 |
| 4066 | 23544 | M00055002B:G06 | MA198:D10 |
| 4067 | 23555 | M00055749A:C09 | MA170:B04 |
| 4068 | 23559 | M00055750A:F10 | MA170:D04 |
| 4069 | 23565 | M00055757A:H06 | MA170:G04 |
| 4070 | 23591 | M00055200B:F03 | MA196:D04 |
| 4071 | 23595 | M00055203B:F05 | MA196:F04 |
| 4072 | 23657 | M00055980B:F12 | MA179:E04 |
| 4073 | 23667 | M00056066C:H10 | MA179:B10 |
| 4074 | 23669 | M00056067B:F12 | MA179:C10 |
| 4075 | 23671 | M00056075D:H10 | MA179:D10 |
| 4076 | 23672 | M00056962D:A05 | MA177:D10 |
| 4077 | 23673 | M00056081D:B09 | MA179:E10 |
| 4078 | 23674 | M00056963A:E01 | MA177:E10 |
| 4079 | 23675 | M00056081D:C02 | MA179:F10 |
| 4080 | 23678 | M00056964D:C08 | MA177:G10 |
| 4081 | 23679 | M00056084A:B08 | MA179:H10 |
| 4082 | 23683 | M00054750C:G08 | MA188:B04 |
| 4083 | 23685 | M00054750D:F04 | MA188:C04 |
| 4084 | 23693 | M00054757A:F05 | MA188:G04 |
| 4085 | 23695 | M00054760D:B10 | MA188:H04 |
| 4086 | 23746 | M00042847A:A04 | MA172:A04 |
| 4087 | 23748 | M00042847A:D10 | MA172:B04 |
| 4088 | 23755 | M00054917B:G02 | MA168:F04 |
| 4089 | 23765 | M00055468D:D05 | MA168:C10 |
| 4090 | 23767 | M00055469B:E11 | MA168:D10 |
| 4091 | 23773 | M00055492C:C01 | MA168:G10 |
| 4092 | 23775 | M00055496A:E06 | MA168:H10 |
| 4093 | 23787 | M00056742D:D01 | MA175:F04 |
| 4094 | 23805 | M00056814D:C08 | MA175:G10 |
| 4095 | 23827 | RG:1636303:10014:B10 | MA163:B10 |
| 4096 | 23829 | RG:1643142:10014:C10 | MA163:C10 |
| 4097 | 23831 | RG:1650444:10014:D10 | MA163:D10 |
| 4098 | 23840 | RG:1418984:10003:H10 | MA152:H10 |
| 4099 | 23841 | M00043339C:C12 | MA183:A04 |
| 4100 | 23843 | M00043342C:H03 | MA183:B04 |
| 4101 | 23847 | M00043350A:C04 | MA183:D04 |
| 4102 | 23875 | M00056646D:G05 | MA186:B04 |
| 4103 | 23880 | M00055406C:H08 | MA199:D04 |
| 4104 | 23887 | M00056653C:F06 | MA186:H04 |
| 4105 | 23888 | M00055408A:H06 | MA199:H04 |
| 4106 | 23905 | M00055545D:E02 | MA169:A05 |
| 4107 | 23909 | M00055548B:H07 | MA169:C05 |
| 4108 | 23912 | M00056271C:F02 | MA181:D05 |
| 4109 | 23915 | M00055550D:A05 | MA169:F05 |
| 4110 | 23929 | M00055661A:F09 | MA169:E11 |
| 4111 | 24003 | M00056427D:A09 | MA173:B05 |
| 4112 | 24004 | M00056163C:H09 | MA180:B05 |
| 4113 | 24005 | M00056428B:F07 | MA173:C05 |
| 4114 | 24006 | M00056163D:E01 | MA180:C05 |
| 4115 | 24009 | M00056428C:A12 | MA173:E05 |
| 4116 | 24011 | M00056429D:D07 | MA173:F05 |
| 4117 | 24014 | M00056175D:B05 | MA180:G05 |
| 4118 | 24017 | M00056507D:D04 | MA173:A11 |
| 4119 | 24027 | M00056511D:H07 | MA173:F11 |
| 4120 | 24033 | M00054654A:F12 | MA187:A05 |
| 4121 | 24034 | M00054868D:F12 | MA189:A05 |
| 4122 | 24039 | M00054661B:H10 | MA187:D05 |
| 4123 | 24043 | M00054666B:C07 | MA187:F05 |
| 4124 | 24044 | M00054870B:H05 | MA189:F05 |
| 4125 | 24045 | M00054669B:B03 | MA187:G05 |
| 4126 | 24049 | M00054706B:G04 | MA187:A11 |
| 4127 | 24055 | M00054720C:F01 | MA187:D11 |
| 4128 | 24057 | M00054722B:E08 | MA187:E11 |
| 4129 | 24058 | M00054908A:H08 | MA189:E11 |
| 4130 | 24061 | M00054723B:H12 | MA187:G11 |
| 4131 | 24070 | M00057210B:G10 | MA193:C05 |
| 4132 | 24084 | M00057248D:B05 | MA193:B11 |
| 4133 | 24092 | M00057252A:F06 | MA193:F11 |
| 4134 | 24099 | M00042573B:A02 | MA167:B05 |
| 4135 | 24108 | M00042766A:E10 | MA171:F05 |
| 4136 | 24113 | M00042882D:G08 | MA167:A11 |
| 4137 | 24115 | M00042885C:A12 | MA167:B11 |
| 4138 | 24116 | M00042815A:F07 | MA171:B11 |
| 4139 | 24118 | M00042817B:E11 | MA171:C11 |
| 4140 | 24121 | M00042887C:A07 | MA167:E11 |
| 4141 | 24126 | M00042818D:A08 | MA171:G11 |
| 4142 | 24133 | M00056552A:G08 | MA174:C05 |
| 4143 | 24135 | M00056552C:D08 | MA174:D05 |
| 4144 | 24137 | M00056553C:E10 | MA174:E05 |
| 4145 | 24143 | M00056555B:C11 | MA174:H05 |
| 4146 | 24151 | M00056611C:D03 | MA174:D11 |
| 4147 | 24155 | M00056611D:B03 | MA174:F11 |
| 4148 | 24157 | M00056611D:F08 | MA174:G11 |
| 4149 | 24159 | M00056614C:F06 | MA174:H11 |
| 4150 | 24161 | RG:358387:10009:A05 | MA158:A05 |
| 4151 | 24193 | M00057302A:F08 | MA182:A05 |

TABLE 31-continued

| SEQ ID NO | Spot ID | Clone ID | MAClone ID |
|---|---|---|---|
| 4152 | 24197 | M00057302C:H09 | MA182:C05 |
| 4153 | 24204 | M00054496A:B09 | MA184:F05 |
| 4154 | 24208 | M00054496A:H05 | MA184:H05 |
| 4155 | 24209 | M00042460B:A08 | MA182:A11 |
| 4156 | 24210 | M00054524B:B09 | MA184:A11 |
| 4157 | 24212 | M00054526C:E05 | MA184:B11 |
| 4158 | 24213 | M00042516B:A08 | MA182:C11 |
| 4159 | 24215 | M00042517D:H10 | MA182:D11 |
| 4160 | 24216 | M00054527B:H11 | MA184:D11 |
| 4161 | 24217 | M00042517D:H11 | MA182:E11 |
| 4162 | 24222 | M00054529C:G04 | MA184:G11 |
| 4163 | 24223 | M00043300D:A06 | MA182:H11 |
| 4164 | 24230 | M00054958A:G10 | MA198:C05 |
| 4165 | 24232 | M00054958B:B07 | MA198:D05 |
| 4166 | 24240 | M00054961D:E08 | MA198:H05 |
| 4167 | 24246 | M00055015C:H02 | MA198:C11 |
| 4168 | 24250 | M00055016B:D03 | MA198:E11 |
| 4169 | 24265 | M00055764D:D05 | MA170:E05 |
| 4170 | 24275 | M00055815C:E08 | MA170:B11 |
| 4171 | 24283 | M00055819B:B12 | MA170:F11 |
| 4172 | 24287 | M00055820C:H11 | MA170:H11 |
| 4173 | 24289 | M00055204B:C04 | MA196:A05 |
| 4174 | 24295 | M00055209A:C09 | MA196:D05 |
| 4175 | 24311 | M00055252C:G12 | MA196:D11 |
| 4176 | 24354 | M00056934C:D08 | MA177:A05 |
| 4177 | 24355 | M00055989C:D03 | MA179:B05 |
| 4178 | 24360 | M00055937C:G12 | MA177:D05 |
| 4179 | 24367 | M00055997B:A02 | MA179:H05 |
| 4180 | 24373 | M00056087A:G01 | MA179:C11 |
| 4181 | 24375 | M00056091A:H05 | MA179:D11 |
| 4182 | 24378 | M00056966B:A05 | MA177:E11 |
| 4183 | 24379 | M00056093A:F08 | MA179:F11 |
| 4184 | 24383 | M00056096C:H10 | MA179:H11 |
| 4185 | 24399 | M00054766B:E10 | MA188:H05 |
| 4186 | 24403 | M00054817B:H09 | MA188:B11 |
| 4187 | 24407 | M00054818D:G04 | MA188:D11 |
| 4188 | 24450 | M00042851D:H04 | MA172:A05 |
| 4189 | 24452 | M00042853A:F01 | MA172:B05 |
| 4190 | 24457 | M00055426A:G06 | MA168:E05 |
| 4191 | 24467 | M00055496A:G12 | MA168:B11 |
| 4192 | 24475 | M00055509C:C02 | MA168:F11 |
| 4193 | 24477 | M00055510B:F08 | MA168:G11 |
| 4194 | 24479 | M00055510D:A08 | MA168:H11 |
| 4195 | 24483 | M00056748C:B08 | MA175:B05 |
| 4196 | 24485 | M00056749A:F01 | MA175:C05 |
| 4197 | 24493 | M00056754B:A10 | MA175:G05 |
| 4198 | 24495 | M00056754B:H06 | MA175:H05 |
| 4199 | 24521 | RG:1653390:10014:E05 | MA163:E05 |
| 4200 | 24525 | RG:1669553:10014:G05 | MA163:G05 |
| 4201 | 24547 | M00043355A:H12 | MA183:B05 |
| 4202 | 24549 | M00043355B:F10 | MA183:C05 |
| 4203 | 24557 | M00043357B:B10 | MA183:G05 |
| 4204 | 24558 | M00054557C:D09 | MA185:G05 |
| 4205 | 24559 | M00043358B:G11 | MA183:H05 |
| 4206 | 24561 | M00043396D:B04 | MA183:A11 |
| 4207 | 24576 | M00054612D:D11 | MA185:H11 |
| 4208 | 24578 | M00055409B:D08 | MA199:A05 |
| 4209 | 24580 | M00055409D:F06 | MA199:B05 |
| 4210 | 24582 | M00055410A:A06 | MA199:C05 |
| 4211 | 24587 | M00056659A:D08 | MA186:F05 |
| 4212 | 24599 | M00056704C:H08 | MA186:D11 |
| 4213 | 24609 | M00055553C:B06 | MA169:A06 |
| 4214 | 24610 | M00056280B:D10 | MA181:A06 |
| 4215 | 24614 | M00056282D:G10 | MA181:C06 |
| 4216 | 24622 | M00056288B:A12 | MA181:G06 |
| 4217 | 24627 | M00055686B:E11 | MA169:B12 |
| 4218 | 24630 | M00042346B:F09 | MA181:C12 |
| 4219 | 24633 | M00055698C:E05 | MA169:E12 |
| 4220 | 24634 | M00042347C:D07 | MA181:E12 |
| 4221 | 24635 | M00055702C:C04 | MA169:F12 |
| 4222 | 24638 | M00042348B:F03 | MA181:G12 |
| 4223 | 24648 | M00055335D:E01 | MA197:D06 |
| 4224 | 24708 | M00056180C:E06 | MA180:B06 |
| 4225 | 24712 | M00056184B:G11 | MA180:D06 |
| 4226 | 24721 | M00056514A:F06 | MA173:A12 |
| 4227 | 24727 | M00056514C:H11 | MA173:D12 |
| 4228 | 24741 | M00054674D:C05 | MA187:C06 |
| 4229 | 24743 | M00054675A:H07 | MA187:D06 |
| 4230 | 24744 | M00054878A:G12 | MA189:D06 |
| 4231 | 24751 | M00054676B:D07 | MA187:H06 |
| 4232 | 24755 | M00054725A:E09 | MA187:B12 |
| 4233 | 24758 | M00054924C:B09 | MA189:C12 |
| 4234 | 24759 | M00054726D:B04 | MA187:D12 |
| 4235 | 24762 | M00054927A:H09 | MA189:E12 |
| 4236 | 24763 | M00054727C:F11 | MA187:F12 |
| 4237 | 24767 | M00054728A:H05 | MA187:H12 |
| 4238 | 24768 | M00054930B:G05 | MA189:H12 |
| 4239 | 24772 | M00057214C:G11 | MA193:B06 |
| 4240 | 24776 | M00057216C:G01 | MA193:D06 |
| 4241 | 24780 | M00057217C:B07 | MA193:F06 |
| 4242 | 24803 | M00042695A:H04 | MA167:B06 |
| 4243 | 24805 | M00042695D:D09 | MA167:C06 |
| 4244 | 24808 | M00042771A:D01 | MA171:D06 |
| 4245 | 24810 | M00042772D:F02 | MA171:E06 |
| 4246 | 24812 | M00042773A:A12 | MA171:F06 |
| 4247 | 24813 | M00042699B:B10 | MA167:G06 |
| 4248 | 24817 | M00042889A:H07 | MA167:A12 |
| 4249 | 24818 | M00042819A:C09 | MA171:A12 |
| 4250 | 24820 | M00042819C:B03 | MA171:B12 |
| 4251 | 24821 | M00042895B:C02 | MA167:C12 |
| 4252 | 24822 | M00042823B:A02 | MA171:C12 |
| 4253 | 24825 | M00042895D:B04 | MA167:E12 |
| 4254 | 24843 | M00056564B:F11 | MA174:F06 |
| 4255 | 24845 | M00056564C:E08 | MA174:G06 |
| 4256 | 24849 | M00056615D:A01 | MA174:A12 |
| 4257 | 24861 | M00056620D:F02 | MA174:G12 |
| 4258 | 24865 | RG:359184:10009:A06 | MA158:A06 |
| 4259 | 24887 | RG:428530:10009:D12 | MA158:D12 |
| 4260 | 24897 | M00057310A:A07 | MA182:A06 |
| 4261 | 24908 | M00054503C:H10 | MA184:F06 |
| 4262 | 24917 | M00043302C:D03 | MA182:C12 |
| 4263 | 24924 | M00054535B:F10 | MA184:F12 |
| 4264 | 24926 | M00054535C:D10 | MA184:G12 |
| 4265 | 24928 | M00054535C:H09 | MA184:H12 |
| 4266 | 24934 | M00054964B:A08 | MA198:C06 |
| 4267 | 24936 | M00054966C:H01 | MA198:D06 |
| 4268 | 24952 | M00055022D:F01 | MA198:D12 |
| 4269 | 24958 | M00055026C:C12 | MA198:G12 |
| 4270 | 24960 | M00055027B:C11 | MA198:H12 |
| 4271 | 24985 | M00055826D:C11 | MA170:E12 |
| 4272 | 24989 | M00055828C:D10 | MA170:G12 |
| 4273 | 24991 | M00055828D:F12 | MA170:H12 |
| 4274 | 24995 | M00055215C:E11 | MA196:B06 |
| 4275 | 24999 | M00055217C:E09 | MA196:D06 |
| 4276 | 25001 | M00055221B:C01 | MA196:E06 |
| 4277 | 25005 | M00055222A:E02 | MA196:G06 |
| 4278 | 25012 | M00056226D:F03 | MA180:B12 |
| 4279 | 25019 | M00055258A:G02 | MA196:F12 |
| 4280 | 25057 | M00055998A:A02 | MA179:A06 |
| 4281 | 25058 | M00056945A:B11 | MA177:A06 |
| 4282 | 25062 | M00056945D:H03 | MA177:C06 |
| 4283 | 25063 | M00056001A:F11 | MA179:D06 |
| 4284 | 25068 | M00056946D:B04 | MA177:D06 |
| 4285 | 25073 | M00056101B:B02 | MA179:A12 |
| 4286 | 25081 | M00056110C:D09 | MA179:E12 |
| 4287 | 25083 | M00056111B:H03 | MA179:F12 |
| 4288 | 25101 | M00054772B:H06 | MA188:G06 |
| 4289 | 25109 | M00054825B:B05 | MA188:C12 |
| 4290 | 25111 | M00054831A:G04 | MA188:D12 |
| 4291 | 25115 | M00054831D:B07 | MA188:F12 |
| 4292 | 25156 | M00042862D:A12 | MA172:B06 |
| 4293 | 25162 | M00042864A:E05 | MA172:E06 |
| 4294 | 25164 | M00042864D:E06 | MA172:F06 |
| 4295 | 25177 | M00055514B:A05 | MA168:E12 |
| 4296 | 25191 | M00056763B:A12 | MA175:D06 |
| 4297 | 25195 | M00056767D:F06 | MA175:F06 |
| 4298 | 25201 | M00056821A:D08 | MA175:A12 |
| 4299 | 25205 | M00056822C:G03 | MA175:C12 |
| 4300 | 25209 | M00056823D:H02 | MA175:E12 |
| 4301 | 25217 | RG:1609994:10014:A06 | MA163:A06 |
| 4302 | 25243 | RG:1667183:10014:F12 | MA163:F12 |
| 4303 | 25249 | M00043358D:C06 | MA183:A06 |
| 4304 | 25250 | M00054558B:E05 | MA185:A06 |
| 4305 | 25257 | M00043361B:G03 | MA183:E06 |

TABLE 31-continued

| SEQ ID NO | Spot ID | Clone ID | MAClone ID |
|---|---|---|---|
| 4306 | 25277 | M00043408C:D11 | MA183:G12 |
| 4307 | 25280 | M00054632A:E11 | MA185:H12 |
| 4308 | 25281 | M00056661A:G05 | MA186:A06 |
| 4309 | 25283 | M00056661C:C11 | MA186:B06 |
| 4310 | 25284 | M00055412D:E05 | MA199:B06 |
| 4311 | 25286 | M00055413A:G12 | MA199:C06 |
| 4312 | 25288 | M00055414D:A09 | MA199:D06 |
| 4313 | 25301 | M00056707B:C01 | MA186:C12 |
| 4314 | 25317 | M00056237D:C10 | MA181:D01 |
| 4315 | 25319 | M00056238B:D03 | MA181:E01 |
| 4316 | 25323 | M00056239B:D05 | MA181:G01 |
| 4317 | 25325 | M00056241B:H07 | MA181:H01 |
| 4318 | 25380 | I:2921194:04B02:C06 | MA118:C06 |
| 4319 | 25388 | I:1624865:04B02:G06 | MA118:G06 |
| 4320 | 25389 | I:1728607:04A02:H06 | MA116:H06 |
| 4321 | 25390 | I:2827453:04B02:H06 | MA118:H06 |
| 4322 | 25398 | I:2070593:04B02:D12 | MA118:D12 |
| 4323 | 25405 | I:2683114:04A02:H12 | MA116:H12 |
| 4324 | 25419 | I:1809336:02A02:G06 | MA108:G06 |

Characterization of Sequences

The sequences of the isolated polynucleotides were first masked to eliminate low complexity sequences using the RepeatMasker masking program, publicly available through a web site supported by the University of Washington (See also Smit, A. F. A. and Green, P., unpublished results). Generally, masking does not influence the final search results, except to eliminate sequences of relatively little interest due to their low complexity, and to eliminate multiple "hits" based on similarity to repetitive regions common to multiple sequences, e.g., Alu repeats. Masking resulted in the elimination of several sequences.

The remaining sequences of the isolated polynucleotides were used in a homology search of the GenBank database using the TeraBLAST program (TimeLogic, Crystal Bay, Nev.), a DNA and protein sequence homology searching algorithm. TeraBLAST is a version of the publicly available BLAST search algorithm developed by the National Center for Biotechnology, modified to operate at an accelerated speed with increased sensitivity on a specialized computer hardware platform. The program was run with the default parameters recommended by TimeLogic to provide the best sensitivity and speed for searching DNA and protein sequences. Gene assignment for the query sequences was determined based on best hit form the GenBank database; expectancy values are provided with the hit.

Summary of TeraBLAST Search Results

Table 32 provides information about the gene corresponding to each polynucleotide. Table 32 includes: (1) the "SEQ ID NO" of the sequence; (2) the "Clone ID" assigned to the clone from which the sequence was isolated; (3) the "MAClone ID" assigned to the clone from which the sequence was isolated; (4) the percentage of masking of the sequence ("Mask Prcnt") (5) the GenBank Accession Number of the publicly available sequence corresponding to the polynucleotide ("GBHit"); (6) a description of the GenBank sequence ("GBDescription"); and (7) the score of the similarity of the polynucleotide sequence and the GenBank sequence ("GBScore"). The published information for each GenBank and EST description, as well as the corresponding sequence identified by the provided accession number, are incorporated herein by reference.

TABLE 32

| SEQ ID NO | Clone ID | MAClone ID | Mask Prcnt | GBHit | GBDescription | GBScore |
|---|---|---|---|---|---|---|
| 3022 | M00026919B:A10 | MA40:F01 | | Z69708 | gi|1204106|emb|Z69708.1HSL241B9C Human DNA sequence from cosmid L241B9, Huntington's Disease Region, chromosome 4p16.3 contains pol | 2.2E−208 |
| 3023 | M00026919B:E07 | MA40:G01 | | Y16675 | gi|3378616|emb|Y16675.1HSCPRM1 Homo sapiens mRNA for aflatoxin B1-aldehyde reductase | 0 |
| 3024 | M00026919D:F04 | MA40:H01 | | M62810 | gi|188563|gb|M62810.1HUMMITF1 Human mitochondrial transcription factor 1 mRNA, complete cds | 1E−300 |
| 3025 | M00026914D:G06 | MA40:A01 | | NM_020990 | gi|11641403|ref|NM_020990.2 Homo sapiens creatine kinase, mitochondrial 1 (ubiquitous) (CKMT1), nuclear gene encoding mitochondrial | 2.3E−288 |
| 3026 | M00026950A:A09 | MA40:D07 | | BC010020 | gi|14603100|gb|BC010020.1BC010020 Homo sapiens, adaptor-related protein complex 3, sigma 2 subunit, clone MGC: 19643 IMAGE: 2959670, | 9.3E−207 |
| 3027 | M00003820C:A09 | MA244:B01 | 0.83544 | AK026527 | gi|10439404|dbj|AK026527.1AK026527 Homo sapiens cDNA: FLJ22874 fis, clone KAT02871 | 6.6E−24 |
| 3028 | M00001673A:G03 | MA244:E01 | | BC018192 | gi|17390428|gb|BC018192.1BC018192 Homo sapiens, inositol 1,3,4-triphosphate 5/6 kinase, clone MGC: 21491 IMAGE: 3867269, mRNA, comple | 4.6E−274 |
| 3029 | M00007939A:A12 | MA27:B07 | | | | |
| 3030 | M00007939A:B11 | MA27:D07 | | AK055664 | gi|16550447|dbj|AK055664.1AK055664 Homo sapiens cDNA FLJ31102 fis, clone IMR322000010 | 6.7E−186 |
| 3031 | M00007939B:G03 | MA27:H07 | | BC006230 | gi|13623260|gb|BC006230.1BC006230 Homo sapiens, lysophospholipase-like, clone MGC: 10338 IMAGE: 3945191, mRNA, complete cds | 2.3E−151 |

TABLE 32-continued

| SEQ ID NO | Clone ID | MAClone ID | Mask Prcnt | GBHit | GBDescription | GBScore |
|---|---|---|---|---|---|---|
| 3032 | M00007997D:G08 | MA29:C01 | | BC012323 | gi\|15147375\|gb\|BC012323.1BC012323 *Homo sapiens*, Similar to cut (*Drosophila*)-like 1 (CCAAT displacement protein), clone IMAGE: 455060 | 2.1E−198 |
| 3033 | M00026894C:E11 | MA39:F07 | | AF052955 | gi\|8117711\|gb\|AF052955.1AF052955 *Homo sapiens* F1-ATPase epsilon-subunit (ATP5E) mRNA, complete cds; nuclear gene for mitochondrial | 9E−204 |
| 3034 | M00001391A:C05 | MA15:G01 | | AK000140 | gi\|7020034\|dbj\|AK000140.1AK000140 *Homo sapiens* cDNA FLJ20133 fis, clone COL06539 | 2.2E−107 |
| 3035 | M00006818A:A06 | MA240:C01 | 0.06554 | AL136706 | gi\|12052931\|emb\|AL136706.1HSM801674 *Homo sapiens* mRNA; cDNA DKFZp566B2024 (from clone DKFZp566B2024); complete cds | 9.2E−248 |
| 3036 | M00023278A:F09 | MA36:E01 | | | | |
| 3037 | M00023299A:G01 | MA36:C07 | | | | |
| 3038 | M00023301A:A11 | MA36:F07 | | BC007270 | gi\|13938284\|gb\|BC007270.1BC007270 *Homo sapiens*, clone MGC: 15585 IMAGE: 3160319, mRNA, complete cds | 1E−300 |
| 3039 | M00008050A:D12 | MA30:C01 | | BC015839 | gi\|16198382\|gb\|BC015839.1BC015839 *Homo sapiens*, clone IMAGE: 4296901, mRNA | 1.6E−267 |
| 3040 | M00022135A:C04 | MA35:F01 | | BC007925 | gi\|14043985\|gb\|BC007925.1BC007925 *Homo sapiens*, retinoid X receptor, alpha, clone MGC: 14451 IMAGE: 4304205, mRNA, complete cds | 1.3E−124 |
| 3041 | M00022137A:A05 | MA35:G01 | | AK025549 | gi\|10438098\|dbj\|AK025549.1AK025549 *Homo sapiens* cDNA: FLJ21896 fis, clone HEP03441 | 1.6E−267 |
| 3042 | M00022176C:A07 | MA35:A07 | | BC000393 | gi\|12653248\|gb\|BC000393.1BC000393 *Homo sapiens*, Similar to CAAX box 1, clone MGC: 8471 IMAGE: 2821721, mRNA, complete cds | 2.4E−183 |
| 3043 | M00008077B:A08 | MA30:D07 | | U09564 | gi\|507212\|gb\|U09564.1HSU09564 Human serine kinase mRNA, complete cds | 6.3E−211 |
| 3044 | M00008077C:D09 | MA30:G07 | | U50939 | gi\|1314559\|gb\|U50939.1HSU50939 Human amyloid precursor protein-binding protein 1 mRNA, complete cds | 1.4E−258 |
| 3045 | M00022081C:E09 | MA34:F01 | | AJ271408 | gi\|6729589\|emb\|AJ271408.1HSA271408 *Homo sapiens* mRNA for Fas-associated factor, FAF1 (Faf1 gene) | 1E−237 |
| 3046 | M00001662A:G06 | MA24:H01 | | BC006229 | gi\|13623258\|gb\|BC006229.1BC006229 *Homo sapiens*, cytochrome c oxidase subunit Vb, clone MGC: 10622 IMAGE: 3952882, mRNA, complete cds | 1.6E−264 |
| 3047 | M00022102B:B11 | MA34:D07 | | AJ250229 | gi\|8926686\|emb\|AJ250229.1HSA250229 *Homo sapiens* mRNA for chromosome 11 hypothetical protein (ORF1) | 0 |
| 3048 | M00022102B:E08 | MA34:E07 | | | | |
| 3049 | M00022569D:G06 | MA22:F01 | 0.0572 | U08839 | gi\|517197\|gb\|U08839.1HSU08839 Human urokinase-type plasminogen activator receptor mRNA, complete cds | 6.7E−233 |
| 3050 | M00001358B:B11 | MA14:A01 | | AB047848 | gi\|11094286\|dbj\|AB047848.1AB047848 *Homo sapiens* mRNA for zetal-COP, complete cds | 4.3E−299 |
| 3051 | M00001429A:G04 | MA16:A01 | | BC000491 | gi\|12653440\|gb\|BC000491.1BC000491 *Homo sapiens*, proliferating cell nuclear antigen, clone MGC: 8367 IMAGE: 2820036, mRNA, complete cd | 0 |
| 3052 | M00001358B:F05 | MA14:B01 | | BC000706 | gi\|12653834\|gb\|BC000706.1BC000706 *Homo sapiens*, Similar to G8 protein, clone MGC: 1225 IMAGE: 3349773, mRNA, complete cds | 1.1E−299 |
| 3053 | M00001429C:C03 | MA16:C01 | | X16064 | gi\|37495\|emb\|X16064.1HSTUMP Human mRNA for translationally controlled tumor protein | 0 |
| 3054 | M00001359D:B04 | MA14:E01 | | AK000481 | gi\|7020597\|dbj\|AK000481.1AK000481 *Homo sapiens* cDNA FLJ20474 fis, clone KAT07183 | 1E−300 |
| 3055 | M00001360A:E10 | MA14:F01 | | BC002899 | gi\|12804092\|gb\|BC002899.1BC002899 *Homo sapiens*, protein (peptidyl-prolyl cis/trans isomerase) NIMA-interacting 1, clone MGC: 10717 I | 6.4E−267 |

TABLE 32-continued

| SEQ ID NO | Clone ID | MAClone ID | Mask Prcnt | GBHit | GBDescription | GBScore |
|---|---|---|---|---|---|---|
| 3056 | M00001360C:B05 | MA14:G01 | | NM_001014 | gi\|13904867\|ref\|NM_001014.2 *Homo sapiens* ribosomal protein S10 (RPS 10), mRNA | 2.1E−282 |
| 3057 | M00001430B:F01 | MA16:G01 | | AL050096 | gi\|4884121\|emb\|AL050096.1HSM800178 *Homo sapiens* mRNA; cDNA DKFZp586A0419 (from clone DKFZp586A0419); partial cds | 6.9E−47 |
| 3058 | M00001430C:A02 | MA16:H01 | | AF083248 | gi\|5106790\|gb\|AF083248.1AF083248 *Homo sapiens* ribosomal protein L26 homolog mRNA, complete cds | 0 |
| 3059 | M00001445C:H05 | MA16:A07 | | X02152 | gi\|34312\|emb\|X02152.1HSLDHAR Human mRNA for lactate dehydrogenase-A (LDH-A, EC 1.1.1.27) | 0 |
| 3060 | M00001445D:D07 | MA16:B07 | | X73458 | gi\|312997\|emb\|X73458.1HSPLK1 *H. sapiens* plk-1 mRNA | 2.7E−266 |
| 3061 | M00001374D:D10 | MA14:G07 | | BC018620 | gi\|17391359\|gb\|BC018620.1BC018620 *Homo sapiens*, Similar to ADP-ribosyltransferase (NAD+; poly (ADP-ribose) polymerase), clone IMAGE | 8.3E−254 |
| 3062 | M00001375A:A08 | MA14:H07 | | AF231705 | gi\|8745393\|gb\|AF231705.1AF231705 *Homo sapiens* Alu co-repressor 1 (ACR1) mRNA, complete cds | 4.1E−137 |
| 3063 | M00006600A:E07 | MA241:B01 | | AK001635 | gi\|7023008\|dbj\|AK001635.1AK001635 *Homo sapiens* cDNA FLJ10773 fis, clone NT2RP4000246, moderately similar to NPC DERIVED PROLINE RIC | 3.2E−281 |
| 3064 | M00006690A:F06 | MA241:C07 | 0.28152 | | | |
| 3065 | M00023325D:A08 | MA37:B02 | | BC001901 | gi\|12804898\|gb\|BC001901.1BC001901 *Homo sapiens*, BCL2-antagonist of cell death, clone MGC: 2100 IMAGE: 3537914, mRNA, complete cds | 2.7E−294 |
| 3066 | M00026921D:F12 | MA40:C02 | | AK054686 | gi\|16549280\|dbj\|AK054686.1AK054686 *Homo sapiens* cDNA FLJ30124 fis, clone BRACE1000093, highly similar to TNF RECEPTOR ASSOCIATED FA | 0 |
| 3067 | M00023325D:F06 | MA37:D02 | 0.15781 | BC017660 | gi\|17389200\|gb\|BC017660.1BC017660 *Homo sapiens*, clone MGC: 14608 IMAGE: 4049404, mRNA, complete cds | 1.2E−188 |
| 3068 | M00026924A:E09 | MA40:G02 | | AL359938 | gi\|8977893\|emb\|AL359938.1HSM802719 *Homo sapiens* mRNA; cDNA DKFZp547H236 (from clone DKFZp547H236) | 0 |
| 3069 | M00007940C:A04 | MA27:D08 | | AF381986 | gi\|17985445\|gb\|AF381986.1AF381986 *Homo sapiens* haplotype X mitochondrion, complete genome | 1.6E−264 |
| 3070 | M00007941C:H03 | MA27:F08 | | U97519 | gi\|2213812\|gb\|U97519.1HSU97519 *Homo sapiens* podocalyxin-like protein mRNA, complete cds | 4.5E−271 |
| 3071 | M00021638B:F03 | MA31:F08 | | NM_004417 | gi\|7108342\|ref\|NM_004417.2 *Homo sapiens* dual specificity phosphatase 1 (DUSP1), mRNA | 3.2E−250 |
| 3072 | M00007941D:C04 | MA27:H08 | | AL110202 | gi\|5817121\|emb\|AL110202.1HSM800854 *Homo sapiens* mRNA; cDNA DKFZp586I2022 (from clone DKFZp586I2022) | 2.5E−263 |
| 3073 | M00004054D:D02 | | 0.19296 | | | |
| 3074 | M00001507A:A10 | MA23:E08 | | AF220656 | gi\|7107358\|gb\|AF220656.1AF220656 *Homo sapiens* apoptosis-associated nuclear protein PHLDA1 (PHLDA1) mRNA, partial cds | 1.4E−255 |
| 3075 | M00004198D:A01 | | | AY007138 | gi\|9956042\|gb\|AY007138.1 *Homo sapiens* clone CDABP0061 mRNA sequence | 0 |
| 3076 | M00001528C:B08 | MA23:G08 | | AF106066 | gi\|5353548\|gb\|AF106066.1AF106066 *Homo sapiens* RAD17 pseudogene, complete sequence | 4.1E−28 |
| 3077 | M00008002C:A05 | MA29:B03 | | AB023173 | gi\|4589555\|dbj\|AB023173.1AB023173 *Homo sapiens* mRNA for KIAA0956 protein, partial cds | 1.6E−292 |
| 3078 | M00008006C:H05 | MA29:H03 | | AF327923 | gi\|13241760\|gb\|AF327923.1AF327923 *Homo sapiens* transmembrane protein induced by tumor necrosis factor alpha (TMPIT) mRNA, complete | 8.2E−205 |

TABLE 32-continued

| SEQ ID NO | Clone ID | MAClone ID | Mask Prcnt | GBHit | GBDescription | GBScore |
|---|---|---|---|---|---|---|
| 3079 | M00026850C:A01 | MA39:A02 | | AK055812 | gi|16550635|dbj|AK055812.1AK055812 Homo sapiens cDNA FLJ31250 fis, clone KIDNE2005336, weakly similar to Homo sapiens antigen NY-CO | 8.5E−66 |
| 3080 | M00026853D:C07 | MA39:F02 | 0.27143 | AF212248 | gi|13182770|gb|AF212248.1AF212248 Homo sapiens CDA09 mRNA, complete cds | 1.9E−153 |
| 3081 | M00026896A:C09 | MA39:D08 | | AK018953 | gi|12858931|dbj|AK018953.1AK018953 Mus musculus adult male testis cDNA, RIKEN full-length enriched library, clone: 1700111D04, full | 3.9E−139 |
| 3082 | M00001391B:D02 | MA15:C02 | | D86956 | gi|1503985|dbj|D86956.1D86956 Human mRNA for KIAA0201 gene, complete cds | 4.7E−221 |
| 3083 | M00001391B:H05 | MA15:E02 | | AL110153 | gi|5817055|emb|AL110153.1HSM800798 Homo sapiens mRNA; cDNA DKFZp586E0524 (from clone DKFZp586E0524) | 1E−300 |
| 3084 | M00001391D:C07 | MA15:F02 | | AL136593 | gi|7018431|emb|AL136593.1HSM801567 Homo sapiens mRNA; cDNA DKFZp761K102 (from clone DKFZp761K102); complete cds | 0 |
| 3085 | M00001392B:B01 | MA15:G02 | | M73791 | gi|189265|gb|M73791.1HUMANOVGENE Human novel gene mRNA, complete cds | 3.5E−94 |
| 3086 | M00001407B:C03 | MA15:E08 | | BC005116 | gi|13477284|gb|BC005116.1BC005116 Homo sapiens, structure specific recognition protein 1, clone MGC: 1608 IMAGE: 3536048, mRNA, compl | 1E−300 |
| 3087 | M00005635B:E02 | MA242:B08 | 0.86798 | | | |
| 3088 | M00005636B:B06 | MA242:E08 | | AK008041 | gi|12841981|dbj|AK008041.1AK008041 Mus musculus adult male small intestine cDNA, RIKEN full-length enriched library, clone: 2010002G | 1.5E−24 |
| 3089 | M00006971A:E06 | MA240:E08 | | NM_002403 | gi|9665260|ref|NM_002403.2 Homo sapiens microfibrillar-associated protein 2 (MFAP2), transcript variant 2, mRNA | 4.7E−274 |
| 3090 | M00005636D:B08 | MA242:F08 | | | | |
| 3091 | M00023302C:A04 | MA36:B08 | | AF202922 | gi|13540826|gb|AF202922.2AF202922 Homo sapiens LRP16 (LRP16) mRNA, complete cds | 4.6E−231 |
| 3092 | M00023305A:C02 | MA36:G08 | | | | |
| 3093 | M00022180A:E08 | MA35:B08 | | BC018918 | gi|17511926|gb|BC018918.1BC018918 Homo sapiens, clone MGC: 12603 IMAGE: 4130906, mRNA, complete cds | 3.6E−203 |
| 3094 | M00022181C:H11 | MA35:E08 | | AK001485 | gi|7022770|dbj|AK001485.1AK001485 Homo sapiens cDNA FLJ10623 fis, clone NT2RP2005520, highly similar to Homo sapiens chromosome-ass | 1.6E−161 |
| 3095 | M00001673A:C11 | | | U15128 | gi|902744|gb|U15128.1HSU15128 Human beta-1,2-N-acetylglucosaminyltransferase II (MGAT2) gene, complete cds | 0 |
| 3096 | M00003853B:C07 | | | BC008378 | gi|14249982|gb|BC008378.1BC008378 Homo sapiens, programmed cell death 2, clone MGC: 12347 IMAGE: 4102043, mRNA, complete cds | 2.4E−207 |
| 3097 | M00022106B:D04 | MA34:B08 | | AB055387 | gi|12862374|dbj|AB055387.1AB055387 Homo sapiens mitochondrial DNA | 1.4E−86 |
| 3098 | M00003858B:G01 | MA24:E08 | 0.26044 | | | |
| 3099 | M00022109B:A11 | MA34:G08 | | AK023237 | gi|10435081|dbj|AK023237.1AK023237 Homo sapiens cDNA FLJ13175 fis, clone NT2RP3003842 | 0 |
| 3100 | M00022921A:H05 | MA22:F02 | 0.11424 | BC002976 | gi|12804234|gb|BC002976.1BC002976 Homo sapiens, Similar to cytochrome b-561, clone MGC: 2190 IMAGE: 3535771, mRNA, complete cds | 0 |
| 3101 | M00001430D:H07 | MA16:A02 | | X58965 | gi|35069|emb|X58965.1HSNM23H2G H. sapiens RNA for nm23-H2 gene | 1.9E−276 |
| 3102 | M00001360D:H10 | MA14:B02 | | NM_002415 | gi|4505184|ref|NM_002415.1 Homo sapiens macrophage migration inhibitory factor (glycosylation-inhibiting factor) (MIF), mRNA | 6.2E−158 |
| 3103 | M00001431A:E01 | MA16:B02 | | AK026534 | gi|10439413|dbj|AK026534.1AK026534 Homo sapiens cDNA: FLJ22881 fis, clone KAT03571, highly similar to HUMFERL Human ferritin L chai | 1E−300 |

TABLE 32-continued

| SEQ ID NO | Clone ID | MAClone ID | Mask Prcnt | GBHit | GBDescription | GBScore |
|---|---|---|---|---|---|---|
| 3104 | M00001361A:A02 | MA14:C02 | | NM_004053 | gi|15208644|ref|NM_004053.2 *Homo sapiens* bystin-like (BYSL), mRNA | 6.7E−270 |
| 3105 | M00001362A:B03 | MA14:H02 | | L47277 | gi|986911|gb|L47277.1HUMTOPATRA *Homo sapiens* (cell line HepG2, HeLa) alpha topoisomerase truncated-form mRNA, 3'UTR | 1E−296 |
| 3106 | M00001376C:C01 | MA14:A08 | | S73591 | gi|688296|gb|S73591.1S73591 *Homo sapiens* brain-expressed HHCPA78 homolog VDUP1 (Gene) mRNA, complete cds | 5.8E−233 |
| 3107 | M00001449A:D02 | MA16:B08 | | BC013954 | gi|15530314|gb|BC013954.1BC013954 *Homo sapiens*, clone IMAGE: 3505920, mRNA | 9.6E−291 |
| 3108 | M00001378B:A02 | MA14:C08 | | BC002343 | gi|12803082|gb|BC002343.1BC002343 *Homo sapiens*, Similar to nucleolin, clone MGC: 8580 IMAGE: 2960982, mRNA, complete cds | 5.2E−124 |
| 3109 | M00001450A:D12 | MA16:C08 | | AF106622 | gi|4378528|gb|AF106622.1AF106622 *Homo sapiens* mitochondrial inner membrane preprotein translocase Tim17a mRNA, nuclear gene encodin | 5E−280 |
| 3110 | M00001378C:D08 | MA14:D08 | 0.06114 | BC002569 | gi|12803486|gb|BC002569.1BC002569 *Homo sapiens*, ribosomal protein S4, X-linked, clone MGC: 2328 IMAGE: 3139352, mRNA, complete cds | 3E−235 |
| 3111 | M00001451D:F01 | MA16:G08 | | BC001432 | gi|12655154|gb|BC001432.1BC001432 *Homo sapiens*, heterogeneous nuclear ribonucleoprotein F, clone MGC: 2197 IMAGE: 3138435, mRNA, comp | 0 |
| 3112 | M00006628B:A02 | MA241:C02 | | NM_005826 | gi|14141188|ref|NM_005826.2 *Homo sapiens* heterogeneous nuclear ribonucleoprotein R (HNRPR), mRNA | 4.9E−80 |
| 3113 | M00026926C:F03 | MA40:B03 | | AK027855 | gi|14042836|dbj|AK027855.1AK027855 *Homo sapiens* cDNA FLJ14949 fis, clone PLACE2000341, highly similar to *Homo sapiens* sodium-depend | 1.1E−215 |
| 3114 | M00026963B:H03 | MA40:A09 | | BC014557 | gi|17939595|gb|BC014557.1BC014557 *Homo sapiens*, clone IMAGE: 3837222, mRNA | 2.6E−241 |
| 3115 | M00026964A:E10 | MA40:D09 | | NM_013375 | gi|17572813|ref|NM_013375.2 *Homo sapiens* TATA-binding protein-binding protein (ABT1), mRNA | 1.5E−171 |
| 3116 | M00026965C:A11 | MA40:F09 | 0.07092 | AK054883 | gi|16549505|dbj|AK054883.1AK054883 *Homo sapiens* cDNA FLJ30321 fis, clone BRACE2006281 | 1E−176 |
| 3117 | M00001398A:D11 | MA244:C09 | | BC009503 | gi|14550505|gb|BC009503.1BC009503 *Homo sapiens*, G1 to S phase transition 1, clone MGC: 1735 IMAGE: 2822947, mRNA, complete cds | 1E−300 |
| 3118 | M00008095C:H08 | MA31:D03 | | BC000820 | gi|12654032|gb|BC000820.1BC000820 *Homo sapiens*, menage a trois 1 (CAK assembly factor), clone MGC: 5154 IMAGE: 3453943, mRNA, complet | 5.3E−255 |
| 3119 | M00007942A:F12 | MA27:B09 | | NM_001102 | gi|12025669|ref|NM_001102.2 *Homo sapiens* actinin, alpha 1 (ACTN1), mRNA | 2.3E−257 |
| 3120 | M00004212B:B12 | MA25:A09 | 0.11538 | D38112 | gi|644480|dbj|D38112.1HUMMTA *Homo sapiens* mitochondrial DNA, complete sequence | 2.4E−48 |
| 3121 | M00008014C:E11 | MA29:D05 | 0.05435 | AL080111 | gi|5262538|emb|AL080111.1HSM800619 *Homo sapiens* mRNA; cDNA DKFZp586G2222 (from clone DKFZp586G2222) | 1.7E−292 |
| 3122 | M00008015A:B05 | MA29:E05 | | M23161 | gi|339899|gb|M23161.1HUMTRANSC Human transposon-like element mRNA | 1.3E−157 |
| 3123 | M00022049A:B08 | MA33:A05 | | AK001731 | gi|7023175|dbj|AK001731.1AK001731 *Homo sapiens* cDNA FLJ10869 fis, clone NT2RP4001677 | 5.8E−286 |
| 3124 | M00026856B:F08 | MA39:A03 | | AK023351 | gi|10435249|dbj|AK023351.1AK023351 *Homo sapiens* cDNA FLJ13289 fis, clone OVARC1001170 | 1.7E−298 |
| 3125 | M00026856C:H12 | MA39:B03 | 0.55489 | | | |
| 3126 | M00026900D:A03 | MA39:F09 | | NM_000995 | gi|16117786|ref|NM_000995.2 *Homo sapiens* ribosomal protein L34 (RPL34), transcript variant 1, mRNA | 3.5E−200 |

TABLE 32-continued

| SEQ ID NO | Clone ID | MAClone ID | Mask Prcnt | GBHit | GBDescription | GBScore |
|---|---|---|---|---|---|---|
| 3127 | M00026900D:C12 | MA39:G09 | | BC014377 | gi|15680094|gb|BC014377.1BC014377 *Homo sapiens*, clone IMAGE: 4041545, mRNA, partial cds | 1.2E−274 |
| 3128 | M00026901D:A03 | MA39:H09 | | AK057845 | gi|16553806|dbj|AK057845.1AK057845 *Homo sapiens* cDNA FLJ25116 fis, clone CBR05731, highly similar to EPHRIN-A1 PRECURSOR | 3.6E−178 |
| 3129 | M00001393A:G03 | MA15:E03 | | NM_001015 | gi|14277698|ref|NM_001015.2 *Homo sapiens* ribosomal protein S11 (RPS11), mRNA | 0 |
| 3130 | M00001409B:D03 | MA15:D09 | | AF104914 | gi|4206125|gb|AF104914.1AF104914 *Homo sapiens* map 3p22; 9.65 cR from CHLC.GATA87B02 repeat region, complete sequence | 0 |
| 3131 | M00001409B:G01 | MA15:E09 | | Z69043 | gi|2398656|emb|Z69043.1HSTRAPRNA *H. sapiens* mRNA translocon-associated protein delta subunit precursor | 3.1E−278 |
| 3132 | M00001410C:C09 | MA15:F09 | | BC007261 | gi|13938270|gb|BC007261.1BC007261 *Homo sapiens*, clone MGC: 15545 IMAGE: 3050745, mRNA, complete cds | 5.3E−252 |
| 3133 | M00001410D:A03 | MA15:G09 | | X52003 | gi|311379|emb|X52003.1HSPS2MKN *H. sapiens* pS2 protein gene | 3.9E−265 |
| 3134 | M00005504D:F06 | MA242:A03 | 0.33179 | AK026112 | gi|10438858|dbj|AK026112.1AK026112 *Homo sapiens* cDNA: FLJ22459 fis, clone HRC10045 | 5E−144 |
| 3135 | M00005510D:H10 | MA242:G03 | | | | |
| 3136 | M00006990D:D06 | MA240:G09 | | M79321 | gi|187270|gb|M79321.1HUMLYNTK Human Lyn B protein mRNA, complete cds | 3.8E−290 |
| 3137 | SL146 | MA248:A03 | 0.09302 | AF415176 | gi|16589066|gb|AF415176.1AF415176 *Homo sapiens* CSGEF (SGEF) mRNA, complete cds, alternatively spliced | 7.8E−92 |
| 3138 | SL153 | MA248:H03 | | | | |
| 3139 | SL198 | MA248:E09 | 0.45185 | BC008180 | gi|14198240|gb|BC008180.1BC008180 *Homo sapiens*, DKFZP586A0522 protein, clone MGC: 5320 IMAGE: 2900478, mRNA, complete cds | 8.2E−115 |
| 3140 | SL199 | MA248:F09 | | AF415176 | gi|16589066|gb|AF415176.1AF415176 *Homo sapiens* CSGEF (SGEF) mRNA, complete cds, alternatively spliced | 6.2E−92 |
| 3141 | SL200 | MA248:G09 | | BC005307 | gi|13529043|gb|BC005307.1BC005307 *Homo sapiens*, kallikrein 3, (prostate specific antigen), clone MGC: 12378 IMAGE: 3950475, mRNA, com | 3.1E−191 |
| 3142 | M00023283D:C03 | MA36:C03 | | AF070673 | gi|3978241|gb|AF070673.1AF070673 *Homo sapiens* stannin mRNA, complete cds | 3.7E−181 |
| 3143 | M00023283D:D03 | MA36:D03 | | Z69881 | gi|1524091|emb|Z69881.1HSSERCA3M *H. sapiens* mRNA for adenosine triphosphatase, calcium | 1.1E−299 |
| 3144 | M00023284A:D09 | MA36:E03 | | AK024338 | gi|10436699|dbj|AK024338.1AK024338 *Homo sapiens* cDNA FLJ14276 fis, clone PLACE1005128 | 1E−300 |
| 3145 | M00023285D:C05 | MA36:H03 | | U34877 | gi|1143231|gb|U34877.1HSU34877 *Homo sapiens* biliverdin-IX alpha reductase mRNA, complete cds | 6.5E−295 |
| 3146 | M00023306C:H11 | MA36:A09 | | BC003366 | gi|13097197|gb|BC003366.1BC003366 *Homo sapiens*, calcium-regulated heat-stable protein (24 kD), clone MGC: 5235 IMAGE: 2900952, mRNA, c | 0 |
| 3147 | M00023308D:B06 | MA36:C09 | | M57730 | gi|179320|gb|M57730.1HUMB61 Human B61 mRNA, complete cds | 2.1E−176 |
| 3148 | M00023309D:H04 | MA36:E09 | | AL136720 | gi|12052958|emb|AL136720.1HSM801688 *Homo sapiens* mRNA; cDNA DKFZp566J2046 (from clone DKFZp566J2046); complete cds | 0 |
| 3149 | M00023310A:D07 | MA36:F09 | | AL359587 | gi|8655647|emb|AL359587.1HSM802689 *Homo sapiens* mRNA; cDNA DKFZp762M115 (from clone DKFZp762M115) | 0 |
| 3150 | M00008079C:H04 | MA30:B09 | | AF201943 | gi|9295189|gb|AF201943.1AF201943 *Homo sapiens* HAH-P (HAH-P) mRNA, complete cds | 5.6E−258 |

TABLE 32-continued

| SEQ ID NO | Clone ID | MAClone ID | Mask Prcnt | GBHit | GBDescription | GBScore |
|---|---|---|---|---|---|---|
| 3151 | M00008080B:B10 | MA30:F09 | | D50683 | gi\|1827474\|dbj\|D50683.1D50683 *Homo sapiens* mRNA for TGF-betaIIR alpha, complete cds | 1.3E−224 |
| 3152 | M00022198D:C02 | MA35:F09 | | BC001546 | gi\|16306729\|gb\|BC001546.1BC001546 *Homo sapiens*, Similar to RIKEN cDNA 1110064N10 gene, clone MGC: 4924 IMAGE: 3462041, mRNA, complete | 1E−300 |
| 3153 | M00022198D:G03 | MA35:G09 | | X54199 | gi\|31641\|emb\|X54199.1HSGAGMR Human mRNA for GARS-AIRS-GART | 1.1E−231 |
| 3154 | M00003768B:B09 | MA24:D03 | | M32308 | gi\|202453\|gb\|M32308.1MUSZFXAA Mouse zinc finger protein (Zfx) mRNA, complete cds, clone pDP1115 | 2.4E−103 |
| 3155 | M00022110C:A08 | MA34:C09 | | AK026894 | gi\|10439861\|dbj\|AK026894.1AK026894 *Homo sapiens* cDNA: FLJ23241 fis, clone COL01375 | 9.2E−288 |
| 3156 | M00003886C:H08 | MA24:E09 | 0.36691 | AK056001 | gi\|16550873\|dbj\|AK056001.1AK056001 *Homo sapiens* cDNA FLJ31439 fis, clone NT2NE2000707 | 7.9E−146 |
| 3157 | M00023297B:A10 | MA22:D03 | | M33376 | gi\|187444\|gb\|M33376.1HUMMCDR2 Human pseudo-chlordecone reductase mRNA, complete cds | 0 |
| 3158 | M00023314C:G05 | MA22:G03 | | D87071 | gi\|1510142\|dbj\|D87071.1D87071 Human mRNA for KIAA0233 gene, complete cds | 1.7E−178 |
| 3159 | M00001363B:C04 | MA14:D03 | | AY007220 | gi\|9945039\|gb\|AY007220.1 Homo sapiens S100-type calcium binding protein A14 mRNA, complete cds | 1.8E−120 |
| 3160 | M00001434D:F08 | MA16:D03 | | NM_000852 | gi\|6552334\|ref\|NM_000852.2 *Homo sapiens* glutathione S-transferase pi (GSTP1), mRNA | 1E−300 |
| 3161 | M00001435B:A04 | MA16:E03 | | X99920 | gi\|1694827\|emb\|X99920.1HSS100A13 *H. sapiens* mRNA for S100 calcium-binding protein A13 | 1.1E−265 |
| 3162 | M00001435B:B09 | MA16:F03 | | Y00433 | gi\|31917\|emb\|Y00433.1HSGSHPX Human mRNA for glutathione peroxidase (EC 1.11.1.9.) | 8.4E−226 |
| 3163 | M00001435C:F08 | MA16:H03 | | BC006498 | gi\|13676331\|gb\|BC006498.1BC006498 *Homo sapiens*, ribonucleotide reductase M1 polypeptide, clone MGC: 2326 IMAGE: 2989344, mRNA, comple | 1E−300 |
| 3164 | M00001381A:F03 | MA14:A09 | | BC007590 | gi\|14043203\|gb\|BC007590.1BC007590 *Homo sapiens*, ribosomal protein, large, P1, clone MGC: 15616 IMAGE: 3343021, mRNA, complete cds | 4.8E−246 |
| 3165 | M00001453B:E11 | MA16:B09 | | BC001182 | gi\|12654686\|gb\|BC001182.1BC001182 *Homo sapiens*, clone MGC: 2616 IMAGE: 3357266, mRNA, complete cds | 1E−300 |
| 3166 | M00001453C:D02 | MA16:D09 | | BC007435 | gi\|13938568\|gb\|BC007435.1BC007435 *Homo sapiens*, RNA binding motif protein, X chromosome, clone MGC: 4146 IMAGE: 3010123, mRNA, comple | 1E−300 |
| 3167 | M00007121D:A05 | MA243:A03 | | BC012816 | gi\|15215444\|gb\|BC012816.1BC012816 *Homo sapiens*, TGFB-induced factor 2 (TALE family homeobox), clone MGC: 4139 IMAGE: 2964507, mRNA, c | 1E−300 |
| 3168 | M00007122C:F03 | MA243:B03 | | BC001866 | gi\|12804840\|gb\|BC001866.1BC001866 *Homo sapiens*, replication factor C (activator 1) 5 (36.5 kD), clone MGC: 1155 IMAGE: 3544137, mRNA, | 6.4E−227 |
| 3169 | M00006638A:G02 | MA241:C03 | | J05036 | gi\|181193\|gb\|J05036.1HUMCTSE Human cathepsin E mRNA, complete cds | 6.7E−153 |
| 3170 | M00006639B:H09 | MA241:F03 | 0.36075 | BC014188 | gi\|15559664\|gb\|BC014188.1BC014188 *Homo sapiens*, Similar to golgi autoantigen, golgin subfamily a, 2, clone MGC: 20672 IMAGE: 4644480, | 5.6E−135 |
| 3171 | M00007127C:C11 | MA243:H03 | | AB020718 | gi\|4240310\|dbj\|AB020718.1AB020718 *Homo sapiens* mRNA for KIAA0911 protein, complete cds | 0 |
| 3172 | M00006720D:C11 | MA241:E09 | | AF242773 | gi\|7638246\|gb\|AF242773.1AF242773 *Homo sapiens* mesenchymal stem cell protein DSCD75 mRNA, complete cds | 1.2E−218 |
| 3173 | M00006728C:E07 | MA241:F09 | | L05093 | gi\|401844\|gb\|L05093.1HUMRIBPROD *Homo sapiens* ribosomal protein L18a mRNA, complete cds | 0 |

TABLE 32-continued

| SEQ ID NO | Clone ID | MAClone ID | Mask Prcnt | GBHit | GBDescription | GBScore |
|---|---|---|---|---|---|---|
| 3174 | M00026931D:E08 | MA40:F04 | | AK056187 | gi|16551522|dbj|AK056187.1AK056187 Homo sapiens cDNA FLJ31625 fis, clone NT2RI2003304 | 2.9E−275 |
| 3175 | M00026932D:B08 | MA40:G04 | | NM_022553 | gi|15022812|ref|NM_022553.2 Homo sapiens SAC2 (suppressor of actin mutations 2, yeast, homolog)-like (SACM2L), mRNA | 1E−300 |
| 3176 | M00026969D:D02 | MA40:D10 | 0.05447 | AK027681 | gi|14042541|dbj|AK027681.1AK027681 Homo sapiens cDNA FLJ14775 fis, clone NT2RP4000185 | 6.5E−159 |
| 3177 | M00023393B:E02 | MA37:E10 | | BC001449 | gi|12655184|gb|BC001449.1BC001449 Homo sapiens, heterogeneous nuclear ribonucleoprotein R, clone MGC: 2039 IMAGE: 3139052, mRNA, comp | 9.4E−157 |
| 3178 | M00003782D:D06 | MA244:E04 | | BC000705 | gi|12653832|gb|BC000705.1BC000705 Homo sapiens, clone MGC: 861 IMAGE: 3349507, mRNA, complete cds | 1.6E−295 |
| 3179 | M00004105D:B04 | MA244:G04 | | AK056461 | gi|16551872|dbj|AK056461.1AK056461 Homo sapiens cDNA FLJ31899 fis, clone NT2RP7004173 | 1E−300 |
| 3180 | M00001556D:B11 | MA244:D10 | 0.46689 | | | |
| 3181 | M00021664B:G03 | MA31:E10 | 0.87158 | | | |
| 3182 | M00004078A:A07 | | 0.47872 | | | |
| 3183 | M00001561A:B03 | MA23:D10 | | AF090935 | gi|6690235|gb|AF090935.1AF090935 Homo sapiens clone HQ0569 | 3.4E−256 |
| 3184 | M00008023C:A06 | MA29:F07 | | U79296 | gi|1710278|gb|U79296.1HSU79296 Human dihydrolipoamide acetyl transferase mRNA, partial cds | 2.2E−257 |
| 3185 | M00008024C:F02 | MA29:G07 | 0.26504 | AF092737 | gi|4741762|gb|AF092737.1AF092737 Homo sapiens ubiquitously expressed transcript (UXT) mRNA, complete cds | 3.5E−170 |
| 3186 | M00008024C:G06 | MA29:H07 | | BC017335 | gi|16878274|gb|BC017335.1BC017335 Homo sapiens, clone MGC: 29782 IMAGE: 4642600, mRNA, complete cds | 1E−300 |
| 3187 | M00022057C:H10 | MA33:B07 | | AK027629 | gi|14042438|dbj|AK027629.1AK027629 Homo sapiens cDNA FLJ14723 fis, clone NT2RP3001708, weakly similar to TWISTED GASTRULATION PROTE | 6.8E−79 |
| 3188 | M00022059B:B06 | MA33:C07 | | BC005267 | gi|14710008|gb|BC005267.1BC005267 Homo sapiens, clone IMAGE: 3683864, mRNA | 1E−300 |
| 3189 | M00026902B:F10 | MA39:B10 | | L15203 | gi|402482|gb|L15203.1HUMP1BX Human secretory protein (P1.B) mRNA, complete cds | 4.8E−249 |
| 3190 | M00001394D:B08 | MA15:C04 | | U58773 | gi|6502504|gb|U58773.1HSU58773 Human calcium binding protein mRNA, complete cds | 1E−300 |
| 3191 | M00001415A:G05 | MA15:A10 | | BC006337 | gi|3623468|gb|BC006337.1BC006337 Homo sapiens, clone MGC: 12798 IMAGE: 4304127, mRNA, complete cds | 1.5E−205 |
| 3192 | M00001416B:E03 | MA15:B10 | | X57198 | gi|37071|emb|X57198.1HSTFIIS Human TFIIS mRNA for transcription elongation factor | 0 |
| 3193 | M00001421B:B12 | MA15:H10 | | AF083246 | gi|5106786|gb|AF083246.1HSPC028 Homo sapiens HSPC028 mRNA, complete cds | 0 |
| 3194 | M00005528C:E02 | MA242:G04 | | AK054675 | gi|16549267|dbj|AK054675.1AK054675 Homo sapiens cDNA FLJ30113 fis, clone BNGH42000474 | 1.5E−286 |
| 3195 | M00023312D:F10 | MA36:A10 | 0.47266 | | | |
| 3196 | M00022157A:C06 | MA35:C04 | 0.05831 | | | |
| 3197 | M00022165A:A11 | MA35:H04 | | AK000084 | gi|7019941|dbj|AK000084.1AK000084 Homo sapiens cDNA FLJ20077 fis, clone COL02904 | 0 |
| 3198 | M00022206A:B10 | MA35:D10 | | AL137546 | gi|6808228|emb|AL137546.1HSM802283 Homo sapiens mRNA; cDNA DKFZp434A1920 (from clone DKFZp434A1920); partial cds | 1E−293 |
| 3199 | M00003811B:F09 | | | BC009470 | gi|14495716|gb|BC009470.1BC009470 Homo sapiens, protein kinase, interferon-inducible double stranded RNA dependent activator, clone | 0 |

TABLE 32-continued

| SEQ ID NO | Clone ID | MAClone ID | Mask Prcnt | GBHit | GBDescription | GBScore |
|---|---|---|---|---|---|---|
| 3200 | M00003812D:A11 | | | AK026526 | gi\|10439403\|dbj\|AK026526.1AK026526 *Homo sapiens* cDNA: FLJ22873 fis, clone KAT02673, highly similar to HUML12A Human ribosomal prote | 7.6E−137 |
| 3201 | M00022088D:C10 | MA34:G04 | | | | |
| 3202 | M00003910B:C12 | | | AF132945 | gi\|4680660\|gb\|AF132945.1AF132945 *Homo sapiens* CGI-11 protein mRNA, complete cds | 0 |
| 3203 | M00001366A:F06 | MA14:A04 | | U24704 | gi\|2078477\|gb\|U24704.1HSU24704 Human antisecretory factor-1 mRNA, complete cds | 0 |
| 3204 | M00001435C:F12 | MA16:B04 | | BC003576 | gi\|13097755\|gb\|BC003576.1BC003576 *Homo sapiens*, actinin, alpha 1, clone MGC: 2358 IMAGE: 3547017, mRNA, complete cds | 1E−300 |
| 3205 | M00001436B:E11 | MA16:C04 | | BC003573 | gi\|13097746\|gb\|BC003573.1BC003573 *Homo sapiens*, farnesyl-diphosphate farnesyltransferase 1, clone MGC: 2200 IMAGE: 3538137, mRNA, com | 0 |
| 3206 | M00001366B:E01 | MA14:D04 | | AK000609 | gi\|7020817\|dbj\|AK000609.1AK000609 *Homo sapiens* cDNA FLJ20602 fis, clone KAT07189 | 1E−300 |
| 3207 | M00001436C:C03 | MA16:D04 | | Z37986 | gi\|780262\|emb\|Z37986.1HSPHBIPRM *H. sapiens* mRNA for phenylalkylamine binding protein | 1E−300 |
| 3208 | M00001437A:B01 | MA16:F04 | | NM_000994 | gi\|15812220\|ref\|NM_000994.2 *Homo sapiens* ribosomal protein L32 (RPL32), mRNA | 4.1E−240 |
| 3209 | M00001437B:B08 | MA16:G04 | | AF095287 | gi\|3766235\|gb\|AF095287.1AF095287 *Homo sapiens* pituitary tumor transforming gene protein 1 (PTTG1) mRNA, complete cds | 2.5E−294 |
| 3210 | M00001467B:H05 | | | J04456 | gi\|187109\|gb\|J04456.1HUMLEC Human 14 kd lectin mRNA, complete cds | 1.9E−273 |
| 3211 | M00001468A:D02 | MA16:F10 | | U71213 | gi\|1621431\|gb\|U71213.1HSMIGST04 *Homo sapiens* microsomal glutathione s-transferase gene, exon 4, alternatively spliced transcripts, | 5.7E−127 |
| 3212 | M00007131B:B11 | MA243:B04 | | BC017931 | gi\|17389843\|gb\|BC017931.1BC017931 *Homo sapiens*, Similar to RIKEN cDNA 1110055A02 gene, clone MGC: 23962 IMAGE: 4669658, mRNA, complet | 0 |
| 3213 | M00006650A:A10 | MA241:E04 | | | | |
| 3214 | M00006653C:B09 | MA241:G04 | 0.0956 | M17885 | gi\|190231\|gb\|M17885.1HUMPPARP0 Human acidic ribosomal phosphoprotein P0 mRNA, complete cds | 2.6E−186 |
| 3215 | M00007154B:H08 | MA243:G04 | | BC016367 | gi\|16741029\|gb\|BC016367.1BC016367 *Homo sapiens*, retinal short-chain dehydrogenase/reductase retSDR2, clone MGC: 24582 IMAGE: 4133318, | 1E−300 |
| 3216 | M00006740A:E02 | MA241:A10 | | | | |
| 3217 | M00021621A:D04 | MA243:A10 | | NM_003137 | gi\|15834623\|ref\|NM_003137.2 *Homo sapiens* SFRS protein kinase 1 (SRPK1), mRNA | 2.3E−285 |
| 3218 | M00006740B:F11 | MA241:B10 | | AK022929 | gi\|10434601\|dbj\|AK022929.1AK022929 *Homo sapiens* cDNA FLJ12867 fis, clone NT2RP2003702, highly similar to *Homo sapiens* 17 beta-hydro | 4.9E−277 |
| 3219 | M00006741C:A01 | MA241:C10 | | AF201939 | gi\|9295181\|gb\|AF201939.1AF201939 *Homo sapiens* DC5 (DC5) mRNA, complete cds | 7.6E−183 |
| 3220 | M00022171C:A04 | MA243:F10 | | BC000793 | gb\|12653990\|gb\|BC000793.1BC000793 *Homo sapiens*, eukaryotic translation initiation factor 1A, clone MGC: 5131 IMAGE: 3451631, mRNA, co | 0 |
| 3221 | M00026937C:B08 | MA40:E05 | | AF151534 | gi\|8099341\|gb\|AF151534.1AF151534 *Homo sapiens* core histone macroH2A2.2 (MACROH2A2) mRNA, complete cds | 9.5E−177 |
| 3222 | M00023367A:H06 | MA37:G05 | 0.04244 | BC015958 | gi\|16358989\|gb\|BC015958.1BC015958 *Homo sapiens*, clone MGC: 15290 IMAGE: 3940309, mRNA, complete cds | 2.6E−257 |
| 3223 | M00026985C:E12 | MA40:F11 | | BC000927 | gi\|12654216\|gb\|BC000927.1BC000927 *Homo sapiens*, Similar to poly (A) polymerase, clone MGC: 5378 IMAGE: 3445706, mRNA, complete cds | 0 |

TABLE 32-continued

| SEQ ID NO | Clone ID | MAClone ID | Mask Prcnt | GBHit | GBDescription | GBScore |
|---|---|---|---|---|---|---|
| 3224 | M00008100A:A07 | MA31:B05 | | AF247820 | gi\|13186200\|gb\|AF247820.3AF247820 Homo sapiens NAG22 protein mRNA, complete cds | 4.1E−237 |
| 3225 | M00007936B:H07 | MA27:E05 | | BC001929 | gi\|12804952\|gb\|BC001929.1BC001929 Homo sapiens, clone MGC: 3993 IMAGE: 2819500, mRNA, complete cds | 8.4E−145 |
| 3226 | M00008100C:E05 | MA31:F05 | 0.05241 | AF395203 | gi\|15028449\|gb\|AF395203.1AF395203 Cercopithecus aethiops DnaJ-like protein (dj2) mRNA, complete cds | 6.5E−156 |
| 3227 | M00007947B:B02 | MA27:E11 | | | | |
| 3228 | M00004105A:C09 | MA25:F05 | | BC010042 | gi\|14603152\|gb\|BC010042.1BC010042 Homo sapiens, clone MGC: 19606 IMAGE: 3629513, mRNA, complete cds | 1.6E−202 |
| 3229 | M00001433C:D09 | MA23:G05 | | U23070 | gi\|1262172\|gb\|U23070.1HSU23070 Human putative transmembrane protein (nma) mRNA, complete cds | 0 |
| 3230 | M00008027B:D09 | MA29:B09 | | M33132 | gi\|189423\|gb\|M33132.1HUMP12AA Human proliferating cell nucleolar protein P120 gene, exons 1-15 | 4.8E−165 |
| 3231 | M00008028D:B01 | MA29:D09 | | AB014595 | gi\|3327203\|dbj\|AB014595.1AB014595 Homo sapiens mRNA for KIAA0695 protein, complete cds | 1E−300 |
| 3232 | M00008039A:C09 | MA29:F09 | 0.04 | BC013869 | gi\|17105403\|gb\|BC013869.1BC013869 Homo sapiens, clone IMAGE: 3831740, mRNA | 2.6E−291 |
| 3233 | M00026905A:A10 | MA39:A11 | | AF069073 | gi\|3202003\|gb\|AF069073.1AF069073 Homo sapiens P8 protein mRNA, complete cds | 0 |
| 3234 | M00026905D:C05 | MA39:C11 | | BC010631 | gi\|14714946\|gb\|BC010631.1BC010631 Homo sapiens, clone IMAGE: 3867552, mRNA | 3.3E−281 |
| 3235 | M00001401B:A06 | MA15:G05 | | U90313 | gi\|2393721\|gb\|U90313.1HSU90313 Human glutathione-S-transferase homolog mRNA, complete cds | 0 |
| 3236 | M00001402A:A08 | MA15:H05 | 0.03584 | X74215 | gi\|414045\|emb\|X74215.1HSLON H. sapiens mRNA for Lon protease-like protein | 7E−181 |
| 3237 | M00005534C:E12 | MA242:A05 | 0.55385 | | | |
| 3238 | M00005542A:D09 | MA242:D05 | | NM_001428 | gi\|16507965\|ref\|NM_001428.2 Homo sapiens enolase 1, (alpha) (ENO1), mRNA | 1.1E−218 |
| 3239 | M00007031D:E02 | MA240:F11 | | NM_005463 | gi\|14110410\|ref\|NM_005463.2 Homo sapiens heterogeneous nuclear ribonucleoprotein D-like (HNRPDL), transcript variant 1, mRNA | 2.8E−186 |
| 3240 | M00007032A:D04 | MA240:G11 | | D89678 | gi\|3218539\|dbj\|D89678.1D89678 Homo sapiens mRNA for A+U-rich element RNA binding factor, complete cds | 5.2E−225 |
| 3241 | M00005813C:F12 | MA242:H11 | | BC000659 | gi\|12653746\|gb\|BC000659.1BC000659 Homo sapiens, clone MGC: 1004 IMAGE: 3347423, mRNA, complete cds | 1.8E−245 |
| 3242 | SL163 | MA248:B05 | 0.82548 | | | |
| 3243 | SL164 | MA248:C05 | 0.43491 | AF415175 | gi\|16589063\|gb\|AF415175.1AF415175 Homo sapiens putative SH3 domain-containing guanine exchange factor SGEF (SGEF) mRNA, complete cd | 4.9E−102 |
| 3244 | SL167 | MA248:F05 | 0.13452 | AK025140 | gi\|10437598\|dbj\|AK025140.1AK025140 Homo sapiens cDNA: FLJ21487 fis, clone COL05419 | 5.5E−159 |
| 3245 | SL168 | MA248:G05 | 0.72115 | | | |
| 3246 | SL169 | MA248:H05 | | | | |
| 3247 | M00023320B:A03 | MA36:H11 | | BC006428 | gi\|13623618\|gb\|BC006428.1BC006428 Homo sapiens, hypothetical protein, clone MGC: 12969 IMAGE: 3343683, mRNA, complete cds | 6.8E−298 |
| 3248 | M00005350B:F10 | MA246:C05 | | BC014191 | gi\|15559670\|gb\|BC014191.1BC014191 Homo sapiens, clone MGC: 20633 IMAGE: 4761663, mRNA, complete cds | 4.7E−218 |
| 3249 | M00008069D:F01 | MA30:B05 | 0.09317 | | | |
| 3250 | M00022165B:C08 | MA35:B05 | | BC012585 | gi\|15214891\|gb\|BC012585.1BC012585 Homo sapiens, clone IMAGE: 4332982, mRNA | 5.4E−199 |
| 3251 | M00022165C:E12 | MA35:D05 | | NM_001024 | gi\|14670385\|ref\|NM_001024.2 Homo sapiens ribosomal protein S21 (RPS21), mRNA | 4E−184 |

TABLE 32-continued

| SEQ ID NO | Clone ID | MAClone ID | Mask Prcnt | GBHit | GBDescription | GBScore |
|---|---|---|---|---|---|---|
| 3252 | M00022166C:E07 | MA35:E05 | | D87717 | gi|1663709|dbj|D87717.1D87717 Human mRNA for KIAA0013 gene, complete cds | 1.8E−139 |
| 3253 | M00008072D:E12 | MA30:F05 | | BC007581 | gi|14043186|gb|BC007581.1BC007581 *Homo sapiens*, aldehyde dehydrogenase 4 family, member A1, clone MGC: 15564 IMAGE: 3139944, mRNA, co | 6.5E−264 |
| 3254 | M00022211B:D05 | MA35:A11 | | AK025494 | gi|10438028|dbj|AK025494.1AK025494 *Homo sapiens* cDNA: FLJ21841 fis, clone HEP01831 | 2.3E−226 |
| 3255 | M00008089A:E09 | MA30:G11 | | AB050577 | gi|14317901|dbj|AB050577.1AB050577 *Homo sapiens* NUF2 mRNA for kinetochore protein Nuf2, complete cds | 1.1E−231 |
| 3256 | M00003974D:E04 | MA24:C11 | | AF136185 | gi|6625654|gb|AF136185.1AF136185 *Homo sapiens* collagen type XVII (COL17A1) gene, 3' UTR, long form | 3.5E−228 |
| 3257 | M00003980D:F10 | MA24:F11 | | AF150100 | gi|5107187|gb|AF150100.1AF150100 *Homo sapiens* small zinc finger-like protein (TIM9a) mRNA, complete cds | 5E−252 |
| 3258 | M00003984D:C08 | MA24:H11 | | AL133560 | gi|6599130|emb|AL133560.1HSM801406 *Homo sapiens* mRNA; cDNA DKFZp434M1414 (from clone DKFZp434M1414); partial cds | 0 |
| 3259 | M00023373D:A01 | MA22:E05 | | AK023875 | gi|10435944|dbj|AK023875.1AK023875 *Homo sapiens* cDNA FLJ13813 fis, clone THYRO1000358, moderately similar to SELENIUM-BINDING LIVER | 2.2E−201 |
| 3260 | M00023396D:D01 | MA22:H05 | 0.48026 | | | |
| 3261 | M00001437D:E12 | MA16:A05 | | M30684 | gi|177064|gb|M30684.1GORMHCBAA *Gorilla gorilla* beta-2-microglobulin mRNA (GOGOB2M) | 2.3E−260 |
| 3262 | M00001438A:B09 | MA16:B05 | | BC005230 | gi|13528857|gb|BC005230.1BC005230 *Homo sapiens*, ubiquinol-cytochrome c reductase binding protein, clone MGC: 12253 IMAGE: 3961169, mR | 3.6E−259 |
| 3263 | M00001369A:C07 | MA14:E05 | | AF097514 | gi|4808600|gb|AF097514.1AF097514 *Homo sapiens* stearoyl-CoA desaturase (SCD) mRNA, complete cds | 2.2E−229 |
| 3264 | M00001439C:A07 | MA16:F05 | | BC017270 | gi|16878126|gb|BC017270.1BC017270 *Homo sapiens*, homolog of yeast long chain polyunsaturated fatty acid elongation enzyme 2, clone M | 3.7E−106 |
| 3265 | M00001369C:A05 | MA14:H05 | | AF190167 | gi|6456117|gb|AF190167.1AF190167 *Homo sapiens* membrane associated protein SLP-2 (HUSLP2) mRNA, complete cds | 1E−300 |
| 3266 | M00001468D:B11 | MA16:A11 | | BC008442 | gi|14250074|gb|BC008442.1BC008442 *Homo sapiens*, Similar to transmembrane 4 superfamily member 1, clone MGC: 14656 IMAGE: 4101110, mRN | 5.3E−149 |
| 3267 | M00001386B:F08 | MA14:B11 | | AF132818 | gi|6580834|gb|AF132818.1AF132818 *Homo sapiens* colon Kruppel-like factor (CKLF) mRNA, complete cds | 3E−169 |
| 3268 | M00001387A:A08 | MA14:F11 | | NM_022551 | gi|14165467|ref|NM_022551.2 *Homo sapiens* ribosomal protein S18 (RPS18), mRNA | 7E−298 |
| 3269 | M00007163A:B10 | MA243:B05 | | D29013 | gi|517113|dbj|D29013.1HUMLNCAP Human mRNA for DNA polymerase beta, complete cds | 1.5E−178 |
| 3270 | M00006675C:A06 | MA241:E05 | | BC009534 | gi|16306927|gb|BC009534.1BC009534 *Homo sapiens*, clone IMAGE: 3891886, mRNA, partial cds | 3.1E−250 |
| 3271 | M00007191C:A06 | MA243:G05 | | BC001765 | gi|12804678|gb|BC001765.1BC001765 *Homo sapiens*, Similar to stromal antigen 2, clone MGC: 1282 IMAGE: 3352347, mRNA, complete cds | 1.7E−295 |
| 3272 | M00006678A:D02 | MA241:H05 | | NM_002475 | gi|17986280|ref|NM_002475.2 *Homo sapiens* myosin light chain 1 slow a (MLC1SA), mRNA | 1E−240 |
| 3273 | M00026941C:A12 | MA40:E06 | | BC018910 | gi|17511916|gb|BC018910.1BC018910 *Homo sapiens*, clone MGC: 10643 IMAGE: 3959973, mRNA, complete cds | 2.6E−149 |
| 3274 | M00026996A:E01 | MA40:E12 | 0.05985 | AF238079 | gi|7542489|gb|AF238079.1AF238079 *Homo sapiens* FK506 binding protein precursor (FKBP19) mRNA, complete cds | 0 |

TABLE 32-continued

| SEQ ID NO | Clone ID | MAClone ID | Mask Prcnt | GBHit | GBDescription | GBScore |
|---|---|---|---|---|---|---|
| 3275 | M00023401B:E06 | MA37:G12 | 0.71373 | | | |
| 3276 | M00027005B:D03 | MA40:H12 | | AL137626 | gi|6808422|emb|AL137626.1HSM802390 *Homo sapiens* mRNA; cDNA DKFZp434O0712 (from clone DKFZp434O0712); partial cds | 5.8E−289 |
| 3277 | M00007937B:A02 | MA27:C06 | | Z18948 | gi|396712|emb|Z18948.1HSS100E *H. sapiens* mRNA for S100E calcium binding protein | 1.3E−174 |
| 3278 | M00021612C:E11 | MA31:C06 | 0.60788 | AB032969 | gi|6329965|dbj|AB032969.1AB032969 *Homo sapiens* mRNA for KIAA1143 protein, partial cds | 1.2E−92 |
| 3279 | M00007938C:C12 | MA27:G06 | | BC002360 | gi|12803112|gb|BC002360.1BC002360 *Homo sapiens*, U5 snRNP-specific protein, 116 kD, clone MGC: 8581 IMAGE: 2960986, mRNA, complete cds | 3.1E−122 |
| 3280 | M00001623C:A06 | MA23:F12 | | BC000629 | gi|12653688|gb|BC000629.1BC000629 *Homo sapiens*, Similar to aspartyl-tRNA synthetase, clone MGC: 1562 IMAGE: 3344322, mRNA, complete c | 9.9E−238 |
| 3281 | M00001630D:A11 | MA23:G12 | | AF179626 | gi|6457296|gb|AF179626.1AF179626 Expression vector pGP100, complete sequence | 1.7E−298 |
| 3282 | M00008044B:E11 | MA29:A11 | | AF083420 | gi|5326765|gb|AF083420.1AF083420 *Homo sapiens* brain-specific STE20-like protein kinase 3 (STK3) mRNA, complete cds | 4.5E−268 |
| 3283 | M00008044C:C10 | MA29:B11 | | AF224759 | gi|12043739|gb|AF224759.1AF224759 *Homo sapiens* adenocarcinoma antigen ART1/P17 mRNA, complete cds | 1.3E−277 |
| 3284 | M00008044D:B08 | MA29:C11 | 0.82704 | BC019356 | gi|17939588|gb|BC019356.1BC019356 *Homo sapiens*, clone IMAGE: 3503646, mRNA | 5.4E−27 |
| 3285 | M00008044D:C05 | MA29:D11 | | M23161 | gi|339899|gb|M23161.1HUMTRANSC Human transposon-like element mRNA | 5.4E−160 |
| 3286 | M00022074C:A04 | MA33:E11 | | | | |
| 3287 | M00026910C:D12 | MA39:E12 | | J03037 | gi|179771|gb|J03037.1HUMCAIIA Human carbonic anhydrase II mRNA, complete cds | 2.4E−263 |
| 3288 | M00026913A:D06 | MA39:G12 | | AK058163 | gi|16554226|dbj|AK058163.1AK058163 *Homo sapiens* cDNA FLJ25434 fis, clone TST06728, highly similar to ELONGATION FACTOR 1-ALPHA 1 | 2.9E−275 |
| 3289 | M00001402C:H08 | MA15:D06 | | BC000461 | gi|12653382|gb|BC000461.1BC000461 *Homo sapiens*, eukaryotic translation initiation factor 2, subunit 2 (beta, 38 kD), clone MGC: 8508 | 0 |
| 3290 | M00001404C:C11 | MA15:F06 | | BC001497 | gi|16306642|gb|BC001497.1BC001497 *Homo sapiens*, clone MGC: 2068 IMAGE: 2823581, mRNA, complete cds | 1.4E−286 |
| 3291 | M00005587B:G05 | MA242:C06 | | BC001566 | gi|16306756|gb|BC001566.1BC001566 *Homo sapiens*, clone IMAGE: 3451980, mRNA, partial cds | 8.5E−282 |
| 3292 | M00006934D:D10 | MA240:C06 | | D63861 | gi|1769811|dbj|D63861.1D63861 *Homo sapiens* DNA for cyclophilin 40, complete cds | 7.5E−142 |
| 3293 | SL176 | MA248:G06 | | | | |
| 3294 | M00023295D:E05 | MA36:A06 | | M16957 | gi|188249|gb|M16957.1HUMMHDRA2D Human MHC class II HLA-DR2 (Dw2) b-associated glycoprotein beta-chain mRNA, 3' end | 5.2E−227 |
| 3295 | M00023320B:C02 | MA36:A12 | | | | |
| 3296 | M00005401B:F12 | MA246:B12 | | U47742 | gi|1517913|gb|U47742.1HSU47742 Human monocytic leukaemia zinc finger protein (MOZ) mRNA, complete cds | 4.4E−54 |
| 3297 | M00008074D:C05 | MA30:F06 | | AF035289 | gi|2661043|gb|AF035289.1AF035289 *Homo sapiens* clone 23969 mRNA sequence | 3.3E−197 |
| 3298 | M00022175B:F06 | MA35:G06 | | U81002 | gi|4580010|gb|U81002.1HSU81002 *Homo sapiens* TRAF4 associated factor 1 mRNA, partial cds | 1.1E−212 |
| 3299 | M00022230B:C10 | MA35:G12 | | BC019061 | gi|17512149|gb|BC019061.1BC019061 *Homo sapiens*, Similar to RIKEN cDNA 1500019E20 gene, clone IMAGE: 5089739, mRNA | 7.5E−149 |

TABLE 32-continued

| SEQ ID NO | Clone ID | MAClone ID | Mask Prcnt | GBHit | GBDescription | GBScore |
|---|---|---|---|---|---|---|
| 3300 | M00022093C:C08 | MA34:C06 | | AB061831 | gi\|17932955\|dbj\|AB061831.1AB061831 *Homo sapiens* RPL32 gene for ribosomal protein L32, complete cds and sequence | 1.1E−184 |
| 3301 | M00022093C:C12 | MA34:D06 | | BC009401 | gi\|14424786\|gb\|BC009401.1BC009401 *Homo sapiens*, natural killer cell transcript 4, clone MGC: 15353 IMAGE: 4300407, mRNA, complete cds | 9.9E−294 |
| 3302 | M00022132A:H07 | MA34:F12 | | BC015557 | gi\|15990394\|gb\|BC015557.1BC015557 *Homo sapiens*, clone MGC: 1567 IMAGE: 3050731, mRNA, complete cds | 1E−300 |
| 3303 | M00023397B:D04 | MA22:A06 | | AF083441 | gi\|5813822\|gb\|AF083441.1AF083441 *Homo sapiens* SUI1 isolog mRNA, complete cds | 1E−300 |
| 3304 | M00023399D:G04 | MA22:E06 | | BC004450 | gi\|13325265\|gb\|BC004450.1BC004450 *Homo sapiens*, hypothetical protein MGC2650, clone MGC: 4188 IMAGE: 2820830, mRNA, complete cds | 1E−300 |
| 3305 | M00001439D:C09 | MA16:A06 | | BC002446 | gi\|12803262\|gb\|BC002446.1BC002446 *Homo sapiens*, MRJ gene for a member of the DNAJ protein family, clone MGC: 1152 IMAGE: 3346070, mRN | 0 |
| 3306 | M00001441A:A09 | MA16:B06 | | M57710 | gi\|179530\|gb\|M57710.1HUMBPIGE Human IgE-binding protein (epsilon-BP) mRNA, complete cds | 1.7E−295 |
| 3307 | M00001369D:E02 | MA14:C06 | | AF034546 | gi\|3127052\|gb\|AF034546.1AF034546 *Homo sapiens* sorting nexin 3 (SNX3) mRNA, complete cds | 1.9E−195 |
| 3308 | M00001371D:H10 | MA14:E06 | | | | |
| 3309 | M00001372A:D01 | MA14:F06 | | AF151872 | gi\|4929696\|gb\|AF151872.1AF151872 *Homo sapiens* CGI-114 protein mRNA, complete cds | 0 |
| 3310 | M00001444C:F03 | MA16:G06 | | AL359678 | gi\|15215911\|emb\|AL359678.15AL359678 Human DNA sequence from clone RP11-550J21 on chromosome 9, complete sequence [*Homo sapiens*] | 0 |
| 3311 | M00001445A:B02 | | | BC003401 | gi\|13097293\|gb\|BC003401.1BC003401 *Homo sapiens*, ribosomal protein S14, clone MGC: 5429 IMAGE: 3448752, mRNA, complete cds | 9.7E−291 |
| 3312 | M00001388D:F11 | MA14:D12 | | BC002609 | gi\|12803554\|gb\|BC002609.1BC002609 *Homo sapiens*, chromobox homolog 1 (*Drosophila* HP1 beta), clone MGC: 1267 IMAGE: 3140815, mRNA, comp | 0 |
| 3313 | M00001481C:A12 | MA16:F12 | | AB033007 | gi\|6330242\|dbj\|AB033007.1AB033007 *Homo sapiens* mRNA for KIAA1181 protein, partial cds | 2.9E−88 |
| 3314 | M00001389B:B05 | MA14:G12 | | BC013858 | gi\|15426627\|gb\|BC013858.1BC013858 *Homo sapiens*, clone IMAGE: 3869909, mRNA | 2E−239 |
| 3315 | M00001389C:G01 | MA14:H12 | 0.07529 | AY004872 | gi\|9508996\|gb\|AY004872.1 *Homo sapiens* thioredoxin (TXN) mRNA, complete cds | 4.6E−175 |
| 3316 | M00001482D:D11 | MA16:H12 | 0.07738 | BC009982 | gi\|14602997\|gb\|BC009982.1BC009982 *Homo sapiens*, clone IMAGE: 4121355, mRNA, partial cds | 5.1E−169 |
| 3317 | M00006809B:F04 | MA241:D12 | 0.62333 | | | |
| 3318 | I:3325119:07A01:A01 | MA127:A01 | | U21936 | gi\|717118\|gb\|U21936.1HSU21936 Human peptide transporter (HPEPT1) mRNA, complete cds | 1.4E−149 |
| 3319 | I:3033345:07A01:C01 | MA127:C01 | | BC004982 | gi\|13436412\|gb\|BC004982.1BC004982 *Homo sapiens*, glucose phosphate isomerase, clone MGC: 3935 IMAGE: 2906270, mRNA, complete cds | 9E−229 |
| 3320 | I:3176222:07A01:E07 | MA127:E07 | | U09413 | gi\|488554\|gb\|U09413.1HSU09413 Human zinc finger protein ZNF135 mRNA, complete cds | 1.9E−264 |
| 3321 | I:2510627:07B01:G07 | MA129:G07 | | BC002803 | gi\|12803912\|gb\|BC002803.1BC002803 *Homo sapiens*, hypothetical protein, clone MGC: 3402 IMAGE: 3636703, mRNA, complete cds | 1E−300 |
| 3322 | I:1705208:06B01:A01 | MA125:A01 | | X52541 | gi\|31129\|emb\|X52541.1HSEGR1 Human mRNA for early growth response protein 1 (hEGR1) | 0 |
| 3323 | I:1672781:06B01:C07 | MA125:C07 | | BC010042 | gi\|14603152\|gb\|BC010042.1BC010042 *Homo sapiens*, clone MGC: 19606 IMAGE: 3629513, mRNA, complete cds | 1E−300 |

TABLE 32-continued

| SEQ ID NO | Clone ID | MAClone ID | Mask Prcnt | GBHit | GBDescription | GBScore |
|---|---|---|---|---|---|---|
| 3324 | I:1712888:06B01:D07 | MA125:D07 | | AL137469 | gi|6808076|emb|AL137469.1HSM802187 *Homo sapiens* mRNA; cDNA DKFZp434P2422 (from clone DKFZp434P2422); partial cds | 1E−300 |
| 3325 | I:1696224:06B01:E07 | MA125:E07 | | NM_005346 | gi|5579470|ref|NM_005346.2 *Homo sapiens* heat shock 70 kD protein 1B (HSPA1B), mRNA | 1E−300 |
| 3326 | I:3935034:06B01:H07 | MA125:H07 | | BC007616 | gi|14043251|gb|BC007616.1BC007616 *Homo sapiens*, clone MGC: 15728 IMAGE: 3354330, mRNA, complete cds | 1.2E−249 |
| 3327 | I:1800114:03A01:E01 | MA111:E01 | | M24559 | gi|514365|gb|M24559.1HUMIGRPOLY Human poly-Ig receptor transmembrane secretory component mRNA, 3' end | 1.5E−205 |
| 3328 | I:1976029:03A01:D07 | MA111:D07 | | BC000629 | gi|12653688|gb|BC000629.1BC000629 *Homo sapiens*, Similar to aspartyl-tRNA synthetase, clone MGC: 1562 IMAGE: 3344322, mRNA, complete c | 1.1E−299 |
| 3329 | I:1439934:03B01:E07 | MA113:E07 | 0.17464 | M64788 | gi|190855|gb|M64788.1HUMRAP1GAP Human GTPase activating protein (rap1GAP) mRNA, complete cds | 5.9E−184 |
| 3330 | I:2512879:01A01:C01 | MA103:C01 | | M12271 | gi|178091|gb|M12271.1HUMADH1CB *Homo sapiens* class I alcohol dehydrogenase (ADH1) alpha subunit mRNA, complete cds | 3.7E−290 |
| 3331 | I:2900277:01B01:B07 | MA105:B07 | | BC015492 | gi|15930098|gb|BC015492.1BC015492 *Homo sapiens*, clone MGC: 8967 IMAGE: 3915505, mRNA, complete cds | 1E−300 |
| 3332 | I:1479255:01A01:C07 | MA103:C07 | | NM_002245 | gi|15451900|ref|NM_002245.2 *Homo sapiens* potassium channel, subfamily K, member 1 (TWIK-1) (KCNK1), mRNA | 1E−300 |
| 3333 | I:2648612:04B01:A01 | MA117:A01 | | NM_006013 | gi|15718685|ref|NM_006013.2 *Homo sapiens* ribosomal protein L10 (RPL10), mRNA | 1E−300 |
| 3334 | I:1889867:04A01:C01 | MA115:C01 | | AF004563 | gi|3041874|gb|AF004563.1AF004563 *Homo sapiens* hUNC18b alternatively-spliced mRNA, complete cds | 8.2E−148 |
| 3335 | I:1858905:04A01:D01 | MA115:D01 | | BC015520 | gi|15930171|gb|BC015520.1BC015520 *Homo sapiens*, ribonuclease, RNase A family, 4, clone MGC: 9306 IMAGE: 3905439, mRNA, complete cds | 1.8E−211 |
| 3336 | I:2591494:04B01:H01 | MA117:H01 | | BC009084 | gi|14290606|gb|BC009084.1BC009084 *Homo sapiens*, Similar to selenium binding protein 1, clone MGC: 9270 IMAGE: 3853674, mRNA, complete | 0 |
| 3337 | I:2916261:04B01:A07 | MA117:A07 | | BC016855 | gi|16877177|gb|BC016855.1BC016855 *Homo sapiens*, clone MGC: 17066 IMAGE: 3850361, mRNA, complete cds | 5.9E−289 |
| 3338 | I:2397815:04B01:B07 | MA117:B07 | | BC007888 | gi|14043894|gb|BC007888.1BC007888 *Homo sapiens*, eukaryotic translation initiation factor 2, subunit 2 (beta, 38 kD), clone MGC: 1417 | 3.3E−253 |
| 3339 | I:2182095:04B01:D07 | MA117:D07 | | NM_002580 | gi|4505604|ref|NM_002580.1 *Homo sapiens* pancreatitis-associated protein (PAP), mRNA | 5.8E−289 |
| 3340 | I:2506194:02A01:A01 | MA107:A01 | | U36601 | gi|1036798|gb|U36601.1HSU36601 *Homo sapiens* heparan N-deacetylase/N-sulfotransferase-2 mRNA, complete cds | 1.3E−240 |
| 3341 | I:1806219:02A01:C01 | MA107:C01 | | U34279 | gi|1236798|gb|U34279.1HSU34279 Human uroguanylin mRNA, complete cds | 5.4E−202 |
| 3342 | I:1729724:02A01:G07 | MA107:G07 | | NM_002487 | gi|10800414|ref|NM_002487.2 *Homo sapiens* necdin homolog (mouse) (NDN), mRNA | 3.1E−169 |
| 3343 | I:1886842:05A02:G01 | MA120:G01 | | BC010578 | gi|14714852|gb|BC010578.1BC010578 *Homo sapiens*, clone MGC: 9344 IMAGE: 3458845, mRNA, complete cds | 1.5E−292 |
| 3344 | I:1352669:05A02:B07 | MA120:B07 | 0.10093 | BC016752 | gi|16876952|gb|BC016752.1BC016752 *Homo sapiens*, clone IMAGE: 2959721, mRNA | 1.4E−169 |
| 3345 | I:1755847:05B02:C07 | MA122:C07 | | U51095 | gi|1777771|gb|U51095.1HSUS1095 Human homeobox protein Cdx1 mRNA, complete cds | 5.9E−230 |
| 3346 | I:1803418:05B02:D07 | MA122:D07 | | BC006168 | gi|13544071|gb|1BC006168.1BC006168 *Homo sapiens*, clone IMAGE: 3960207, mRNA, partial cds | 0 |

TABLE 32-continued

| SEQ ID NO | Clone ID | MAClone ID | Mask Prcnt | GBHit | GBDescription | GBScore |
|---|---|---|---|---|---|---|
| 3347 | I:1568725:05B02:F07 | MA122:F07 | 0.36394 | D49410 | gi\|684968\|dbj\|D49410.1HUMIL3RA12 *Homo sapiens* gene for interleukin 3 receptor alpha subunit, exon 12 and partial cds | 7.7E−187 |
| 3348 | I:1857708:05A02:G07 | MA120:G07 | | U43381 | gi\|1155348\|gb\|U43381.1HSU43381 Human Down Syndrome region of chromosome 21 DNA | 1.3E−283 |
| 3349 | I:1687060:05B02:G07 | MA122:G07 | | U57645 | gi\|1816511\|gb\|U57645.1HSU57645 Human helix-loop-helix proteins Id-1 (ID-1) and Id-1' (ID-1) genes, complete cds | 3.3E−281 |
| 3350 | I:3407289:07A02:A07 | MA128:A07 | 0.21116 | AB011135 | gi\|3043649\|dbj\|AB011135.1AB011135 *Homo sapiens* mRNA for KIAA0563 protein, complete cds | 1.7E−68 |
| 3351 | I:1235535:07A02:B07 | MA128:B07 | | NM_001012 | gi\|4506742\|ref\|NM_001012.1 *Homo sapiens* ribosomal protein S8 (RPS8), mRNA | 3.8E−156 |
| 3352 | I:1525795:03B02:D07 | MA114:D07 | | X05360 | gi\|29838\|emb\|X05360.1HSCDC2 Human CDC2 gene involved in cell cycle control | 1.5E−289 |
| 3353 | I:3744592:03A02:H07 | MA112:H07 | | S76992 | gi\|913345\|gb\|S76992.1S76992 VAV2 = VAV oncogene homolog [human, fetal brain, mRNA Partial, 2753 nt] | 1E−194 |
| 3354 | I:1485817:01A02:B01 | MA104:B01 | | L14787 | gi\|292930\|gb\|L14787.1HUMZFPA Human DNA-binding protein mRNA, 3'end | 3.4E−247 |
| 3355 | I:2365149:01B02:B01 | MA106:B01 | | U58917 | gi\|2826475\|gb\|U58917.1HSU58917 *Homo sapiens* IL-17 receptor mRNA, complete cds | 9E−208 |
| 3356 | I:1439677:01A02:D01 | MA104:D01 | | AL096780 | gi\|5420184\|emb\|AL096780.1HS384D86A Novel human gene mapping to chromosome 22p13.33 similar to mouse Choline/Ethanolamine Kinase (O55 | 1.8E−146 |
| 3357 | I:2372275:01B02:G01 | MA106:G01 | | BC019252 | gi\|17939418\|gb\|BC019252.BC019252 *Homo sapiens*, clone MGC: 1111 IMAGE: 3503549, mRNA, complete cds | 1E−300 |
| 3358 | I:3211615:01B02:H01 | MA106:H01 | | BC013808 | gi\|15489437\|gb\|BC013808.1BC013808 *Homo sapiens*, TATA box binding protein (TBP)-associated factor, RNA polymerase I, A, 48 kD, clone | 2E−230 |
| 3359 | I:2368282:01B02:B07 | MA106:B07 | | AK056794 | gi\|16552300\|dbj\|AK056794.1AK056794 *Homo sapiens* cDNA FLJ32232 fis, clone PLACE6004578, highly similar to CYTOCHROME P450 11A1, MITO | 5.8E−209 |
| 3360 | I:1737833:04A02:D01 | MA116:D01 | | D26598 | gi\|565646\|dbj\|D26598.1HUMPSH1 Human mRNA for proteasome subunit HsC10-II, complete cds | 1E−300 |
| 3361 | I:2382192:04B02:F01 | MA118:F01 | | Y12653 | gi\|2546963\|emb\|Y12653.1HSDIUBIQU *H. sapiens* mRNA for diubiquitin | 1.6E−264 |
| 3362 | I:1958902:04A02:D07 | MA116:D07 | | D87258 | gi\|1513058\|dbj\|D87258.1D87258 *Homo sapiens* mRNA for serin protease with IGF-binding motif, complete cds | 0 |
| 3363 | I:1704472:04B02:G07 | MA118:G07 | | U66871 | gi\|1519518\|gb\|U66871.1HSU66871 Human enhancer of rudimentary homolog mRNA, complete cds | 7E−161 |
| 3364 | I:1903767:04A02:H07 | MA116:H07 | | AF025304 | gi\|2739055\|gb\|AF025304.1AF025304 *Homo sapiens* protein-tyrosine kinase EPHB2v (EPHB2) mRNA, complete cds | 1E−300 |
| 3365 | I:1268080:02A02:C01 | MA108:C01 | | AB006631 | gi\|14133200\|dbj\|AB006631.2AB006631 *Homo sapiens* mRNA for KIAA0293 gene, partial cds | 0 |
| 3366 | I:1347384:02A02:C07 | MA108:C07 | | U78579 | gi\|1743878\|gb\|U78579.1HSU78579 Human type I phosphatidylinositol-4-phosphate 5-kinase beta (STM7) mRNA, partial cds | 0 |
| 3367 | I:2344817:08B01:H02 | MA133:H02 | | | | |
| 3368 | I:3236109:08A01:B08 | MA131:B08 | 0.46441 | | | |
| 3369 | I:2832506:07A01:H08 | MA127:H08 | | BC000851 | gi\|12654082\|gb\|BC000851.1BC000851 *Homo sapiens*, ribosomal protein L13, clone IMAGE: 3458439, mRNA | 8.5E−282 |
| 3370 | I:1673876:06B01:B02 | MA125:B02 | | V00568 | gi\|34815\|emb\|V00568.1HSMYC1 Human mRNA encoding the c-myc oncogene | 1E−300 |
| 3371 | I:3686211:06B01:E02 | MA125:E02 | | X59960 | gi\|402620\|emb\|X59960.1HSSPMYEL *H. sapiens* mRNA for sphingomyelinase | 1E−300 |
| 3372 | I:2449837:06B01:H02 | MA125:H02 | | BC000070 | gi\|2652644\|gb\|BC000070.1BC000070 *Homo sapiens*, small nuclear ribonucleoprotein polypeptide G, clone MGC: 1614 IMAGE: 3503973, mRNA, | 3E−219 |

TABLE 32-continued

| SEQ ID NO | Clone ID | MAClone ID | Mask Prcnt | GBHit | GBDescription | GBScore |
|---|---|---|---|---|---|---|
| 3373 | I:1613874:06B01:C08 | MA125:C08 | | AF019952 | gi\|2655036\|gb\|AF019952.1AF019952 *Homo sapiens* tumor suppressing STF cDNA 1 (TSSC1) mRNA, complete cds | 0 |
| 3374 | I:1813409:03A01:C02 | MA111:C02 | | BC009244 | gi\|14328061\|gb\|BC009244.1BC009244 *Homo sapiens*, isocitrate dehydrogenase 2 (NADP+), mitochondrial, clone MGC: 3700 IMAGE: 2959540, mR | 1E-300 |
| 3375 | I:1975514:03A01:A08 | MA111:A08 | | S52873 | gi\|263656\|gb\|S52873.1S52873 cytidine deaminase [human, monocytoid cell line U937, mRNA Partial, 736 nt] | 5.7E-286 |
| 3376 | I:1403294:01A01:B02 | MA103:B02 | 0.13199 | | | |
| 3377 | I:2414624:01B01:D02 | MA105:D02 | | U31278 | gi\|950198\|gb\|U31278.1HSU31278 *Homo sapiens* mitotic feedback control protein Madp2 homolog mRNA, complete cds | 0 |
| 3378 | I:2901811:01B01:H02 | MA105:H02 | | BC013081 | gi\|15341817\|gb\|BC013081.1BC013081 *Homo sapiens*, Similar to metallothionein 3 (growth inhibitory factor (neurotrophic)), clone MGC: 1 | 2.6E-213 |
| 3379 | I:2683564:01B01:B08 | MA105:B08 | | V00522 | gi\|32122\|emb\|V00522.1HSHL01 Human mRNA encoding major histocompatibility complex gene HLA-DR beta-I | 2.5E-294 |
| 3380 | I:2725511:01B01:C08 | MA105:C08 | | AF004849 | gi\|2627330\|gb\|AF004849.1AF004849 *Homo sapiens* PKY protein kinase mRNA, complete cds | 1.4E-177 |
| 3381 | I:1431273:04A01:A02 | MA115:A02 | | M82962 | gi\|535474\|gb\|M82962.1HUMPPH Human N-benzoyl-L-tyrosyl-p-amino-benzoic acid hydrolase alpha subunit (PPH alpha) mRNA, complete cds | 1E-268 |
| 3382 | I:1636639:04B01:A02 | MA117:A02 | | AF055009 | gi\|3005731\|gb\|AF055009.1AF055009 *Homo sapiens* clone 24747 mRNA sequence | 0 |
| 3383 | I:2455617:04B01:D02 | MA117:D02 | | BC008281 | gi\|14249818\|gb\|BC008281.1BC008281 *Homo sapiens*, guanosine monophosphate reductase, clone MGC: 10464 IMAGE: 3635871, mRNA, complete cd | 3.2E-281 |
| 3384 | I:2952504:04B01:F02 | MA117:F02 | | U72849 | gi\|4097996\|gb\|U72849.1HSAPEVPL7 *Homo sapiens* envoplakin (EVPL) gene, exon 22 and complete cds | 1E-300 |
| 3385 | I:1483847:04A01:A08 | MA115:A08 | | AF026293 | gi\|2559011\|gb\|AF026293.1AF026293 *Homo sapiens* chaperonin containing t-complex polypeptide 1, beta subunit (Cctb) mRNA, complete cds | 4E-93 |
| 3386 | I:2923150:04B01:B08 | MA117:B08 | | M18963 | gi\|190978\|gb\|M18963.1HUMREGA Human islet of Langerhans regenerating protein (reg) mRNA, complete cds | 1.2E-237 |
| 3387 | I:1813133:04A01:F08 | MA115:F08 | | X12597 | gi\|32326\|emb\|X12597.1HSHMG1 Human mRNA for high mobility group-1 protein (HMG-1) | 1.3E-255 |
| 3388 | I:2510171:04B01:H08 | MA117:H08 | 0.15344 | X04503 | gi\|36490\|emb\|X04503.1HSSLIPR Human SLPI mRNA fragment for secretory leucocyte protease inhibitor | 1.1E-259 |
| 3389 | I:2190284:02A01:H02 | MA107:H02 | | D84107 | gi\|1669546\|dbj\|D84107.1D84107 *Homo sapiens* mRNA for RBP-MS/type 1, complete cds | 0 |
| 3390 | I:1522716:05B02:B02 | MA122:B02 | | X56134 | gi\|37849\|emb\|X56134.1HSVIMENT Human mRNA for vimentin | 0 |
| 3391 | I:1901271:05A02:G02 | MA120:G02 | | U90916 | gi\|1913897\|gb\|U90916.1HSU90916 Human clone 23815 mRNA sequence | 9E-288 |
| 3392 | I:1820522:05B02:H02 | MA122:H02 | | BC002806 | gi\|12803918\|gb\|BC002806.1BC002806 *Homo sapiens*, phosphatidic acid phosphatase type 2C, clone MGC: 3813 IMAGE: 3659728, mRNA, complete | 1.1E-299 |
| 3393 | I:2365295:05A02:A08 | MA120:A08 | | BC015460 | gi\|15930032\|gb\|BC015460.1BC015460 *Homo sapiens*, Similar to glutaminyl-peptide cyclotransferase (glutaminyl cyclase), clone IMAGE: 39 | 3.8E-26 |
| 3394 | I:1335140:05A02:C08 | MA120:C08 | | X02152 | gi\|34312\|emb\|X02152.1HSLDHAR Human mRNA for lactate dehydrogenase-A (LDH-A, EC 1.1.1.27) | 0 |
| 3395 | I:1822577:05B02:D08 | MA122:D08 | | BC001941 | gi\|12804976\|gb\|BC001941.1BC001941 *Homo sapiens*, tissue specific transplantation antigen P35B, clone MGC: 4302 IMAGE: 2819332, mRNA, c | 1.7E-270 |

TABLE 32-continued

| SEQ ID NO | Clone ID | MAClone ID | Mask Prcnt | GBHit | GBDescription | GBScore |
|---|---|---|---|---|---|---|
| 3396 | I:1306814:06B02:A08 | MA126:A08 | | AK026649 | gi|10439547|dbj|AK026649.1AK026649 *Homo sapiens* cDNA: FLJ22996 fis, clone KAT11938 | 9.8E−135 |
| 3397 | I:3034694:06B02:D08 | MA126:D08 | | BC008935 | gi|14286273|gb|BC008935.1BC008935 *Homo sapiens*, Similar to solute carrier family 25 (mitochondrial carrier; adenine nucleotide tran | 4.6E−299 |
| 3398 | I:1453049:03B02:A02 | MA114:A02 | | X76180 | gi|452649|emb|X76180.1HSLASNA *H. sapiens* mRNA for lung amiloride sensitive Na+ channel protein | 2.7E−269 |
| 3399 | I:1453748:03B02:D02 | MA114:D02 | | BC013579 | gi|15488897|gb|BC013579.1BC013579 *Homo sapiens*, Similar to calpastatin, clone MGC: 9402 IMAGE: 3878564, mRNA, complete cds | 2.6E−135 |
| 3400 | I:3001492:03A02:G02 | MA112:G02 | | X75042 | gi|402648|emb|X75042.1HSRNAREL *H. sapiens* rel proto-oncogene mRNA | 1.6E−295 |
| 3401 | I:3876715:03A02:C08 | MA112:C08 | | BC000373 | gi|12653210|gb|BC000373.1BC000373 *Homo sapiens*, Similar to amyloid beta (A4) precursor-like protein 2, clone MGC: 8371 IMAGE: 2820109 | 6.4E−161 |
| 3402 | I:2992851:03A02:D08 | MA112:D08 | | AF190637 | gi|10441643|gb|AF190637.1AF190637 *Homo sapiens* nephrin mRNA, complete cds | 1.5E−286 |
| 3403 | I:1500649:03B02:G08 | MA114:G08 | | AB008430 | gi|2766164|dbj|AB008430.1AB008430 *Homo sapiens* mRNA for CDEP, complete cds | 1E−234 |
| 3404 | I:1512943:01A02:B02 | MA104:B02 | | AJ005036 | gi|3059108|emb|AJ005036.1HSAJ5036 *Homo sapiens* mRNA for phosphodiesterase 3A (from corpus cavernosum) | 9.1E−288 |
| 3405 | I:1467565:01A02:D02 | MA104:D02 | | BC014991 | gi|15929072|gb|BC014991.1BC014991 *Homo sapiens*, clone MGC: 23226 IMAGE: 4909112, mRNA, complete cds | 3.7E−262 |
| 3406 | I:2455118:01B02:D08 | MA106:D08 | | X16396 | gi|35070|emb|X16396.1HSNMTDC Human mRNA for NAD-dependent methylene tetrahydrofolate dehydrogenase cyclohydrolase (EC 1.5.1.15) | 0 |
| 3407 | I:2840251:01B02:E08 | MA106:E08 | | U52513 | gi|1777781|gb|U52513.1HSU52513 Human RIG-G mRNA, complete cds | 0 |
| 3408 | I:2911347:10B02:E02 | MA67:E02 | 0.28302 | | | |
| 3409 | I:1812030:10B02:G08 | MA67:G08 | | AB049758 | gi|10800085|dbj|AB049758.1AB049758 *Homo sapiens* mawbp mRNA for MAWD binding protein, complete cds | 3.6E−200 |
| 3410 | I:2663606:04B02:F08 | MA118:F08 | | U37690 | gi|1017824|gb|U37690.1HSU37690 Human RNA polymerase II subunit (hsRPB10) mRNA, complete cds | 5.2E−196 |
| 3411 | I:1308333:02A02:E02 | MA108:E02 | | BC017338 | gi|16878283|gb|BC017338.1BC017338 *Homo sapiens*, fucosidase, alpha-L-1, tissue, clone MGC: 29579 IMAGE: 4871788, mRNA, complete cds | 1.4E−286 |
| 3412 | I:1578941:02B02:E02 | MA110:E02 | | AK058013 | gi|16554011|dbj|AK058013.1AK058013 *Homo sapiens* cDNA FLJ25284 fis, clone STM06787, highly similar to 15-HYDROXYPROSTAGLANDIN DEHYDR | 1.2E−246 |
| 3413 | I:1535439:02A02:D08 | MA108:D08 | | M83363 | gi|190096|gb|M83363.1HUMPMCA Human plasma membrane calcium-pumping ATPase (PMCA4) mRNA, complete cds | 3.1E−250 |
| 3414 | I:1857475:02B02:H08 | MA110:H08 | | AF009203 | gi|2454508|gb|AF009203.1AF009203 *Homo sapiens* YAC clone 377A1 unknown mRNA, 3'untranslated region | 1.5E−292 |
| 3415 | I:2908878:08B01:F09 | MA133:F09 | 0.46085 | | | |
| 3416 | I:2830575:07A01:C03 | MA127:C03 | 0.06365 | D16431 | gi|598955|dbj|D16431.1HUMHDGF Human mRNA for hepatoma-derived growth factor, complete cds | 1.7E−289 |
| 3417 | I:1557906:07B01:G03 | MA129:G03 | | AK057477 | gi|16553199|dbj|AK057477.1AK057477 *Homo sapiens* cDNA FLJ32915 fis, clone TESTI2006425 | 5.8E−230 |
| 3418 | I:2200604:06B01:F03 | MA125:F03 | | U47105 | gi|4457236|gb|U47105.2HSU47105 *Homo sapiens* H105e3 (H105e3) mRNA, complete cds | 0 |
| 3419 | I:1653326:06A01:C09 | MA123:C09 | | BC01888 | gi|17403014|gb|BC018881.1BC018881 *Homo sapiens*, clone IMAGE: 3617364, mRNA | 1E−296 |

TABLE 32-continued

| SEQ ID NO | Clone ID | MAClone ID | Mask Prcnt | GBHit | GBDescription | GBScore |
|---|---|---|---|---|---|---|
| 3420 | I:1720149:06A01:G09 | MA123:G09 | | U48959 | gi|7239695|gb|U48959.2HSU48959 *Homo sapiens* myosin light chain kinase (MLCK) mRNA, complete cds | 2.4E−291 |
| 3421 | I:1560987:03B01:G03 | MA113:G03 | | U17077 | gi|1000711|gb|U17077.1HSU17077 Human BENE mRNA, partial cds | 2.3E−92 |
| 3422 | I:1510714:03B01:G09 | MA113:G09 | | NM_000240 | gi|4557734|ref|NM_000240.1 *Homo sapiens* monoamine oxidase A (MAOA), nuclear gene encoding mitochondrial protein, mRNA | 6.3E−264 |
| 3423 | I:2501484:01B01:A03 | MA105:A03 | | AB002438 | gi|2943813|dbj|AB002438.1AB002438 *Homo sapiens* mRNA from chromosome 5q21-22, clone: FBR89 | 1.1E−268 |
| 3424 | I:1379063:01A01:B03 | MA103:B03 | | U28055 | gi|1141776|gb|U28055.1HSU28055 *Homo sapiens* hepatocyte growth factor-like protein homolog mRNA, partial cds | 0 |
| 3425 | I:2797902:01B01:C03 | MA105:C03 | 0.07692 | BC019038 | gi|17512114|gb|BC019038.1BC019038 *Homo sapiens*, small nuclear RNA activating complex, polypeptide 1, 43 kD, clone MGC: 20773 IMAGE: 45 | 6.6E−289 |
| 3426 | I:1805613:01B01:G03 | MA105:G03 | | U79725 | gi|1814276|gb|U79725.1HSU79725 Human A33 antigen precursor mRNA, complete cds | 5.4E−202 |
| 3427 | I:1524885:01A01:H03 | MA103:H03 | | Y12065 | gi|2230877|emb|Y12065.1HSNOP56 *Homo sapiens* mRNA for nucleolar protein hNop56 | 0 |
| 3428 | I:2888464:01B01:H03 | MA105:H03 | | S73591 | gi|688296|gb|S73591.1S73591 *Homo sapiens* brain-expressed HHCPA78 homolog VDUP1 (Gene) mRNA, complete cds | 1.7E−267 |
| 3429 | I:1992788:04B01:B03 | MA117:B03 | | AL161985 | gi|7328121|emb|AL161985.1HSM802609 *Homo sapiens* mRNA; cDNA DKFZp761J1810 (from clone DKFZp761J1810) | 0 |
| 3430 | I:1413451:04A01:F03 | MA115:F03 | | D88648 | gi|2653566|dbj|D88648.1D88648 *Homo sapiens* mRNA for B-FABP, complete cds | 4.1E−184 |
| 3431 | I:2779515:04B01:C09 | MA117:C09 | | AL136543 | gi|6807646|emb|AL136543.1HSM801517 *Homo sapiens* mRNA; cDNA DKFZp761K0511 (from clone DKFZp761K0511); partial cds | 2.2E−285 |
| 3432 | I:1583076:02B01:G09 | MA109:G09 | | NM_000669 | gi|11496888|ref|NM_000669.2 *Homo sapiens* alcohol dehydrogenase 1C (class I), gamma polypeptide (ADH1C), mRNA | 6E−261 |
| 3433 | I:3070110:05A02:B03 | MA120:B03 | | AF061016 | gi|3127126|gb|AF061016.1AF061016 *Homo sapiens* UDP-glucose dehydrogenase (UGDH) mRNA, complete cds | 6.4E−295 |
| 3434 | I:1904493:05A02:H03 | MA120:H03 | | Z22555 | gi|397606|emb|Z22555.1HSCLA1GNA *H. sapiens* encoding CLA-1 mRNA | 9.7E−229 |
| 3435 | I:2860815:05A02:A09 | MA120:A09 | | AF067420 | gi|3201899|gb|AF067420.1AF067420 *Homo sapiens* SNC73 protein (SNC73) mRNA, complete cds | 1.7E−100 |
| 3436 | I:1930135:07A02:G03 | MA128:G03 | | | | |
| 3437 | I:3747901:06B02:G03 | MA126:G03 | | BC004979 | gi|13436403|gb|BC004979.1BC004979 *Homo sapiens*, clone MGC: 3855 IMAGE: 2905681, mRNA, complete cds | 1.6E−289 |
| 3438 | I:1720946:06A02:A09 | MA124:A09 | | BC010733 | gi|14789594|gb|BC010733.1BC010733 *Homo sapiens*, clone IMAGE: 3897044, mRNA, partial cds | 1.1E−296 |
| 3439 | I:2877413:06B02:D09 | MA126:D09 | | BC000700 | gi|12653822|gb|BC000700.1BC000700 *Homo sapiens*, clone MGC: 3101 IMAGE: 3350198, mRNA, complete cds | 5.5E−255 |
| 3440 | I:3035279:06B02:E09 | MA126:E09 | | BC001125 | gi|12654578|gb|BC001125.1BC001125 *Homo sapiens*, peptidylprolyl isomerase B (cyclophilin B), clone MGC: 2224 IMAGE: 2966791, mRNA, com | 2E−276 |
| 3441 | I:2503913:03A02:E09 | MA112:E09 | | BC010952 | gi|15012094|gb|BC010952.1BC010952 *Homo sapiens*, Similar to protease inhibitor 3, skin-derived (SKALP), clone MGC: 13613 IMAGE: 408315 | 1.5E−261 |
| 3442 | I:1517380:01A02:B03 | MA104:B03 | | AB033032 | gi|6330486|dbj|AB033032.1AB033032 *Homo sapiens* mRNA for KIAA1206 protein, partial cds | 1.2E−277 |
| 3443 | I:3138128:01B02:C03 | MA106:C03 | | D31887 | gi|505101|dbj|D31887.1HUMORFKG1P Human mRNA for KIAA0062 gene, partial cds | 1E−300 |

TABLE 32-continued

| SEQ ID NO | Clone ID | MAClone ID | Mask Prcnt | GBHit | GBDescription | GBScore |
|---|---|---|---|---|---|---|
| 3444 | I:2453722:01A02:E03 | MA104:E03 | | BC003582 | gi\|13097770\|gb\|BC003582.1BC003582 *Homo sapiens*, polymerase (RNA) II (DNA directed) polypeptide F, clone MGC: 2669 IMAGE: 3546712, mRN | 1E-300 |
| 3445 | I:1414260:01A02:A09 | MA104:A09 | | AB002318 | gi\|2224580\|dbj\|AB002318.1AB002318 Human mRNA for KIAA0320 gene, partial cds | 3.4E-284 |
| 3446 | I:2891247:01B02:A09 | MA106:A09 | | D43638 | gi\|940399\|dbj\|D43638.1HUMMTG8AP Human mRNA for MTG8a protein, complete cds | 8.4E-151 |
| 3447 | I:1682176:01A02:F09 | MA104:F09 | | U78556 | gi\|1688306\|gb\|U78556.1HSU78556 Human cisplatin resistance associated alpha protein (hCRA alpha) mRNA, complete cds | 1E-293 |
| 3448 | I:2739076:04A02:D03 | MA116:D03 | | NM_001023 | gi\|14591915\|ref\|NM_001023.2 *Homo sapiens* ribosomal protein S20 (RPS20), mRNA | 2.1E-248 |
| 3449 | I:1900378:04B02:F03 | MA118:F03 | | AB002363 | gi\|2224670\|dbj\|AB002363.1AB002363 Human mRNA for KIAA0365 gene, partial cds | 3.1E-275 |
| 3450 | I:1603391:04A02:G03 | MA116:G03 | | AF036874 | gi\|9738910\|gb\|AF036874.1AF036874 *Homo sapiens* multiple endocrine neoplasia type 1 candidate protein number 18 (HSPF2) mRNA, complet | 3.7E-275 |
| 3451 | I:2018222:04A02:C09 | MA116:C09 | | BC008795 | gi\|14250659\|gb\|BC008795.1BC008795 *Homo sapiens*, proteasome (prosome, macropain) subunit, beta type, 9 (large multifunctional protea | 2E-192 |
| 3452 | I:1327263:04A02:F09 | MA116:F09 | | M25629 | gi\|186652\|gb\|M25629.1HUMKALX Human kallikrein mRNA, complete cds, clone clone phKK25 | 1.4E-283 |
| 3453 | I:1734393:02A02:B09 | MA108:B09 | | X73502 | gi\|406853\|emb\|X73502.1HSENCY20 *H. Sapiens* mRNA for cytokeratin 20 | 0 |
| 3454 | I:2190607:02A02:E09 | MA108:E09 | | BC008012 | gi\|14124971\|gb\|BC008012.1BC008012 *Homo sapiens*, eukaryotic translation elongation factor 1 delta (guanine nucleotide exchange prote | 3.5E-244 |
| 3455 | I:2447969:08A01:E04 | MA131:E04 | 0.16896 | | | |
| 3456 | I:1753033:08B01:H10 | MA133:H10 | | AL359055 | gi\|8518180\|emb\|AL359055.1IR2344436 *Homo sapiens* mRNA full length insert cDNA clone EUROIMAGE 2344436 | 9.6E-24 |
| 3457 | I:2456393:07B01:E10 | MA129:E10 | | BC005029 | gi\|13477142\|gb\|BC005029.1BC005029 *Homo sapiens*, hypothetical protein FLJ10718, clone MGC: 12594 IMAGE: 4040181, mRNA, complete cds | 3.6E-259 |
| 3458 | I:1719920:06B01:A04 | MA125:A04 | 0.13978 | BC001903 | gi\|12804902\|gb\|BC001903.1BC001903 *Homo sapiens*, Similar to interleukin 10 receptor, beta, clone MGC: 2210 IMAGE: 3544611, mRNA, compl | 1.4E-274 |
| 3459 | I:2927362:06B01:H04 | MA125:H04 | | BC019336 | gi\|17939560\|gb\|BC019336.1BC019336 *Homo sapiens*, clone IMAGE: 3617778, mRNA, partial cds | 0 |
| 3460 | I:4082816:06B01:F10 | MA125:F10 | | BC001365 | gi\|12655034\|gb\|BC001365.1BC001365 *Homo sapiens*, ribosomal protein L4, clone MGC: 2201 IMAGE: 3051487, mRNA, complete cds | 6.1E-230 |
| 3461 | I:1803446:03A01:A04 | MA111:A04 | | BC000062 | gi\|12652632\|gb\|BC000062.1BC000062 *Homo sapiens*, solute carrier family 1 (neutral amino acid transporter), member 5, clone MGC: 1387 | 1E-300 |
| 3462 | I:1557490:03A01:C04 | MA111:C04 | | BC003560 | gi\|13097707\|gb\|BC003560.1BC003560 *Homo sapiens*, ribophorin II, clone MGC: 1817 IMAGE: 3546673, mRNA, complete cds | 0 |
| 3463 | I:1445895:03B01:E10 | MA113:E10 | | BC009196 | gi\|14327943\|gb\|BC009196.1BC009196 *Homo sapiens*, phosphatidic acid phosphatase type 2B, clone MGC: 15306 IMAGE: 3960223, mRNA, complet | 3.6E-131 |
| 3464 | I:1336836:01A01:H04 | MA103:H04 | | M32215 | gi\|307524\|gb\|M32215.1HUMTSHRX Human thyroid stimulatory hormone receptor (TSHR) mRNA, complete cds | 1E-300 |
| 3465 | I:1802745:01B01:E10 | MA105:E10 | | D42087 | gi\|576555\|dbj\|D42087.1HUMHA0793A Human mRNA for KIAA0118 gene, partial cds | 8.4E-279 |

TABLE 32-continued

| SEQ ID NO | Clone ID | MAClone ID | Mask Prcnt | GBHit | GBDescription | GBScore |
|---|---|---|---|---|---|---|
| 3466 | I:2503003:01B01:H10 | MA105:H10 | | AF020352 | gi\|2655054\|gb\|AF020352.1AF020352 Homo sapiens NADH: ubiquinone oxidoreductase 15 kDa IP subunit mRNA, nuclear gene encoding mitochon | 1.4E−255 |
| 3467 | I:1655377:10A01:F04 | MA64:F04 | | AK000706 | gi\|7020960\|dbj\|AK000706.1AK000706 Homo sapiens cDNA FLJ20699 fis, clone KAIA2372 | 2.7E−210 |
| 3468 | I:1430662:04A01:A04 | MA115:A04 | | AF078035 | gi\|4322303\|gb\|AF078035.1AF078035 Homo sapiens translation initiation factor IF2 mRNA, complete cds | 3.9E−262 |
| 3469 | I:3335055:04A01:G04 | MA115:G04 | | BC004390 | gi\|13325149\|gb\|BC004390.1BC004390 Homo sapiens, phosphatidylserine synthase 1, clone MGC: 10968 IMAGE: 3634879, mRNA, complete cds | 3.7E−181 |
| 3470 | I:2457671:04B01:B10 | MA117:B10 | | BC000469 | gi\|12653398\|gb\|BC000469.1BC000469 Homo sapiens, eukaryotic translation initiation factor 3, subunit 7 (zeta, 66/67 kD), clone MGC: 85 | 4.3E−299 |
| 3471 | I:1641421:02A01:C10 | MA107:C10 | | S69369 | gi\|545844\|gb\|S69369.1S69369 PAX3A = transcription factor [human, adult cerebellum, mRNA, 1248 nt] | 1.5E−180 |
| 3472 | I:1655225:02B01:E10 | MA109:E10 | | AB002331 | gi\|2224606\|dbj\|AB002331.1AB002331 Human mRNA for KIAA0333 gene, partial cds | 7.1E−273 |
| 3473 | I:1313325:05A02:B04 | MA120:B04 | | U09550 | gi\|1184036\|gb\|U09550.1HSU09550 Human oviductal glycoprotein mRNA, complete cds | 5.2E−283 |
| 3474 | I:1558081:05B02:A10 | MA122:A10 | | NM_004530 | gi\|11342665\|ref\|NM_004530.1 Homo sapiens matrix metalloproteinase 2 (gelatinase A, 72 kD gelatinase, 72 kD type IV collagenase) (MMP2) | 0 |
| 3475 | I:1889191:05A02:H10 | MA120:H10 | | BC001619 | gi\|12804426\|gb\|BC001619.1BC001619 Homo sapiens, Similar to aldehyde dehydrogenase 5, clone MGC: 2230 IMAGE: 3356389, mRNA, complete c | 1.1E−299 |
| 3476 | I:3495906:07A02:C10 | MA128:C10 | | U19251 | gi\|2642132\|gb\|U19251.1HSU19251 Homo sapiens neuronal apoptosis inhibitory protein mRNA, complete cds | 0 |
| 3477 | I:3704132:03A02:D10 | MA112:D10 | | Z49194 | gi\|974830\|emb\|Z49194.1HSOBF1 H. sapiens mRNA for oct-binding factor | 1.3E−102 |
| 3478 | I:1636553:03B02:F10 | MA114:F10 | | AB001895 | gi\|2588990\|dbj\|AB001895.1AB001895 Homo sapiens mRNA for B120, complete cds | 2.8E−130 |
| 3479 | I:1402228:03B02:H10 | MA114:H10 | | BC008588 | gi\|14250316\|gb\|BC008588.1BC008588 Homo sapiens, Similar to plastin 3 (T isoform), clone IMAGE: 3447893, mRNA, partial cds | 7.8E−170 |
| 3480 | I:1361963:01A02:B04 | MA104:B04 | | L13616 | gi\|439874\|gb\|L13616.1HUMFAKX Human focal adhesion kinase (FAK) mRNA, complete cds | 2.4E−291 |
| 3481 | I:1510424:01A02:D04 | MA104:D04 | | X04481 | gi\|34627\|emb\|X04481.1HSMH3C2R Human mRNA for complement component C2 | 1E−300 |
| 3482 | I:2918558:01B02:D04 | MA106:D04 | | AF000994 | gi\|2580573\|gb\|AF000994.1HSAF000994 Homo sapiens ubiquitous TPR motif, Y isoform (UTY) mRNA, alternative transcript 3, complete cds | 8.8E−285 |
| 3483 | I:1731061:01A02:D10 | MA104:D10 | | BC000418 | gi\|12653298\|gb\|BC000418.1BC000418 Homo sapiens, ectodermal-neural cortex (with BTB-like domain), clone MGC: 8659 IMAGE: 2964376, mRNA | 1E−300 |
| 3484 | I:2579602:04A02:A04 | MA116:A04 | | BC005128 | gi\|13477308\|gb\|BC005128.1BC005128 Homo sapiens, ribosomal protein L7a, clone MGC: 10607 IMAGE: 3938260, mRNA, complete cds | 1E−300 |
| 3485 | I:2824181:04B02:A04 | MA118:A04 | | BC004900 | gi\|13436172\|gb\|BC004900.1BC004900 Homo sapiens, ribosomal protein L13a, clone IMAGE: 3545758, mRNA, partial cds | 1E−300 |
| 3486 | I:2123183:04A02:B04 | MA116:B04 | | BC001164 | gi\|12654652\|gb\|BC001164.1BC001164 Homo sapiens, proteasome (prosome, macropain) 26S subunit, non-ATPase, 8, clone MGC: 1660 IMAGE: 35 | 2.1E−198 |

TABLE 32-continued

| SEQ ID NO | Clone ID | MAClone ID | Mask Prcnt | GBHit | GBDescription | GBScore |
|---|---|---|---|---|---|---|
| 3487 | I:1958560:04A02:C10 | MA116:C10 | 0.0522 | BC016147 | gi|16359382|gb|BC016147.1BC016147 Homo sapiens, clone MGC: 9485 IMAGE: 3921259, mRNA, complete cds | 1.5E−277 |
| 3488 | I:1447903:04A02:G10 | MA116:G10 | | AK056274 | gi|16551627|dbj|AK056274.1AK056274 Homo sapiens cDNA FLJ31712 fis, clone NT2RI2006445, moderately similar to INSULIN-LIKE GROWTH FA | 2.2E−48 |
| 3489 | I:1875576:02A02:E10 | MA108:E10 | | U04897 | gi|451563|gb|U04897.1HSU04897 Human orphan hormone nuclear receptor RORalpha1 mRNA, complete cds | 1.1E−140 |
| 3490 | I:1709457:02B02:G10 | MA110:G10 | | X65873 | gi|34082|emb|X65873.1HSKHCMR H. sapiens mRNA for kinesin (heavy chain) | 0 |
| 3491 | I:2155675:08B01:G05 | MA133:G05 | 0.83871 | | | |
| 3492 | I:1635069:07A01:A05 | MA127:A05 | | D15049 | gi|475003|dbj|D15049.1HUMSAP1C Homo sapiens mRNA for protein tyrosine phosphatase precursor, complete cds | 3.5E−197 |
| 3493 | I:1453445:07A01:G05 | MA127:G05 | 0.07788 | BC001784 | gi|13937607|gb|BC001784.1BC001784 Homo sapiens, Similar to acidic 82 kDa protein mRNA, clone IMAGE: 3542384, mRNA | 1.2E−265 |
| 3494 | I:3002566:07A01:D11 | MA127:D11 | | D26350 | gi|450468|dbj|D26350.1HUMHT2I Human mRNA for type 2 inositol 1,4,5-trisphosphate receptor, complete cds | 0 |
| 3495 | I:1631511:06A01:C05 | MA123:C05 | | BC001454 | gi|12655192|gb|BC001454.1BC001454 Homo sapiens, phosphoenolpyruvate carboxykinase 2 (mitochondrial), clone MGC: 1492 IMAGE: 3138368, | 0 |
| 3496 | I:1610523:06A01:H05 | MA123:H05 | | L19183 | gi|307154|gb|L19183.1HUMMAC30X Human MAC30 mRNA, 3' end | 0 |
| 3497 | I:3297656:06B01:E11 | MA125:E11 | | D14530 | gi|414348|dbj|D14530.1HUMRSPT Human homolog of yeast ribosomal protein S28, complete cds | 5E−277 |
| 3498 | I:2509730:06B01:H11 | MA125:H11 | | X91788 | gi|1001874|emb|X91788.1HSICLNGEN H. sapiens mRNA for Icln protein | 0 |
| 3499 | I:2121863:03B01:D05 | MA113:D05 | | BC002738 | gi|12803796|gb|BC002738.1BC002738 Homo sapiens, cysteine-rich protein 1 (intestinal), clone MGC: 3888 IMAGE: 3631097, mRNA, complete | 6.9E−47 |
| 3500 | I:1413704:03B01:E05 | MA113:E05 | | NM_003903 | gi|14110370|ref|NM_003903.2 Homo sapiens CDC16 cell division cycle 16 homolog (S. cerevisiae) (CDC16), mRNA | 8.5E−254 |
| 3501 | I:1626232:03A01:A11 | MA111:A11 | | AF048700 | gi|2935439|gb|AF048700.1AF048700 Homo sapiens gastrointestinal peptide (PEC-60) mRNA, complete cds | 3.5E−203 |
| 3502 | I:2354446:01B01:B05 | MA105:B05 | | AF131913 | gi|4928275|gb|AF131913.1AF131913 Homo sapiens alpha-(1,3/1,4)-fucosyltransferase (FT3B) mRNA, complete cds | 1.2E−218 |
| 3503 | I:2916753:01B01:E05 | MA105:E05 | | X62534 | gi|32332|emb|X62534.1HSHMG2 H. sapiens HMG-2 mRNA | 3.9E−179 |
| 3504 | I:2555034:01A01:A11 | MA103:A11 | 0.09272 | U39196 | gi|1055027|gb|U39196.1HSU39196 Human clone hGIRK1 G-protein coupled inwardly rectifying potassium channel mRNA, complete cds | 9.4E−151 |
| 3505 | I:2804190:01B01:D11 | MA105:D11 | | BC004300 | gi|13279166|gb|BC004300.1BC004300 Homo sapiens, Similar to villin-like, clone MGC: 10896 IMAGE: 3622951, mRNA, complete cds | 2.8E−166 |
| 3506 | I:1814488:01A01:E11 | MA103:E11 | | AF044773 | gi|3002950|gb|AF044773.1AF044773 Homo sapiens breakpoint cluster region protein 1 (BCRG1) mRNA, complete cds | 8.8E−208 |
| 3507 | I:2474163:01B01:E11 | MA105:E11 | | J03037 | gi|179771|gb|J03037.1HUMCAIIA Human carbonic anhydrase II mRNA, complete cds | 1.2E−143 |
| 3508 | I:1402967:01A01:G11 | MA103:G11 | | Y00651 | gi|34504|emb|Y00651.1HSMCP Human mRNA for membrane cofactor protein | 1.5E−227 |
| 3509 | I:2821541:10A01:D11 | MA64:D11 | 0.356 | | | |
| 3510 | I:2888814:04B01:A05 | MA117:A05 | | Y10806 | gi|1808645|emb|Y10806.1HSY10806 H. sapiens mRNA for arginine methyltransferase, splice variant, 1316 bp | 1E−300 |
| 3511 | I:1451005:04A01:C05 | MA115:C05 | | BC001771 | gi|12804688|gb|BC001771.1BC001771 Homo sapiens, general transcription factor IIF, polypeptide 2 (30 kD subunit), clone MGC: 1502 IMAG | 3.3E−200 |

TABLE 32-continued

| SEQ ID NO | Clone ID | MAClone ID | Mask Prcnt | GBHit | GBDescription | GBScore |
|---|---|---|---|---|---|---|
| 3512 | I:1457726:04A01:H05 | MA115:H05 | | AK001686 | gi\|7023098\|dbj\|AK001686.1AK001686 Homo sapiens cDNA FLJ10824 fis, clone NT2RP4001086 | 3.9E−209 |
| 3513 | I:2883195:04B01:H05 | MA117:H05 | | BC000672 | gi\|12653772\|gb\|BC000672.1BC000672 Homo sapiens, guanine nucleotide binding protein (G protein), beta polypeptide 2-like 1, clone MG | 1E−290 |
| 3514 | I:1603605:04A01:G11 | MA115:G11 | 0.04363 | D38305 | gi\|1580723\|dbj\|D38305.1HUMTOB Human mRNA for Tob, complete cds | 1.3E−268 |
| 3515 | I:2832224:04A01:H11 | MA115:H11 | | L09604 | gi\|177899\|gb\|L09604.1HUMA4 Homo sapiens differentiation-dependent A4 protein mRNA, complete cds | 0 |
| 3516 | I:2231364:02A01:A05 | MA107:A05 | | D87469 | gi\|1665820\|dbj\|D87469.1D87469 Human mRNA for KIAA0279 gene, partial cds | 0 |
| 3517 | I:1595081:02B01:F11 | MA109:F11 | | S36219 | gi\|249623\|gb\|S36219.1S36219 prostaglandin G/H synthase {alternative splicing product} [human, lung fibroblast, clone HCO-T9, mRNA, | 1E−300 |
| 3518 | I:1877913:05B02:C05 | MA122:C05 | | U51903 | gi\|1262925\|gb\|U51903.1HSU51903 Human RasGAP-related protein (IQGAP2) mRNA, complete cds | 1E−300 |
| 3519 | I:1666130:05B02:F05 | MA122:F05 | | X05790 | gi\|28535\|emb\|X05790.1HSAGALAR Human mRNA for alpha-galactosidase A (EC 3.2.1-22) | 0 |
| 3520 | I:1709995:05B02:H05 | MA122:H05 | | U78525 | gi\|2558667\|gb\|U78525.1HSU78525 Homo sapiens eukaryotic translation initiation factor (eIF3) mRNA, complete cds | 8.3E−279 |
| 3521 | I:3872557:07A02:B05 | MA128:B05 | | NM_000518 | gi\|13788565\|ref\|NM_000518.3 Homo sapiens hemoglobin, beta (HBB), mRNA | 0 |
| 3522 | I:2734906:07A02:E11 | MA128:E11 | | NM_001997 | gi\|17981709\|ref\|NM_001997.2 Homo sapiens Finkel-Biskis-Reilly murine sarcoma virus (FBR-MuSV) ubiquitously expressed (fox derived); | 1.3E−277 |
| 3523 | I:1798585:06A02:B05 | MA124:B05 | | BC008767 | gi\|14250615\|gb\|BC008767.1BC008767 Homo sapiens, Similar to acyl-Coenzyme A oxidase 1, palmitoyl, clone MGC: 1198 IMAGE: 3051501, mRNA | 0 |
| 3524 | I:1683389:06A02:F05 | MA124:F05 | | BC015335 | gi\|15929831\|gb\|BC015335.1BC015335 Homo sapiens, immature colon carcinoma transcript 1, clone MGC: 21251 IMAGE: 4418983, mRNA, complet | 0 |
| 3525 | I:1704517:06A02:G05 | MA124:G05 | | BC005820 | gi\|14710649\|gb\|BC005820.1BC005820 Homo sapiens, clone IMAGE: 3937549, mRNA | 0 |
| 3526 | I:2792982:06B02:H05 | MA126:H05 | | X71345 | gi\|405755\|emb\|X71345.1HSTRYIVB H. sapiens mRNA for trypsinogen IV b-form | 0 |
| 3527 | I:3511355:06B02:D11 | MA126:D11 | | NM_001002 | gi\|16933547\|ref\|NM_001002.2 Homo sapiens ribosomal protein, large, P0 (RPLP0), transcript variant 1, mRNA | 1E−300 |
| 3528 | I:1738060:03A02:A05 | MA112:A05 | | BC000508 | gi\|12653472\|gb\|BC000508.1BC000508 Homo sapiens, proteasome (prosome, macropain) subunit, beta type, 1, clone MGC: 8505 IMAGE: 2822268 | 1.1E−243 |
| 3529 | I:1810821:03B02:B05 | MA114:B05 | | BC016956 | gi\|16877417\|gb\|BC016956.1BC016956 Homo sapiens, clone MGC: 21520 IMAGE: 3900854, mRNA, complete cds | 7E−217 |
| 3530 | I:2451279:03A02:E05 | MA112:E05 | | BC009868 | gi\|14602690\|gb\|BC009868.1BC009868 Homo sapiens, replication protein A3 (14 kD), clone MGC: 16404 IMAGE: 3940438, mRNA, complete cds | 1.8E−167 |
| 3531 | I:1431166:03B02:E05 | MA114:E05 | | BC010444 | gi\|14714612\|gb\|BC010444.1BC010444 Homo sapiens, matrilin 2, clone MGC: 17281 IMAGE: 4215380, mRNA, complete cds | 5.5E−230 |
| 3532 | I:2949427:03B02:A11 | MA114:A11 | | BC006794 | gi\|13905021\|gb\|BC006794.1BC006794 Homo sapiens, Similar to interferon induced transmembrane protein 3 (1-8U), clone MGC: 5225 IMAGE: | 3.2E−225 |
| 3533 | I:1458366:03B02:E11 | MA114:E11 | | AF009202 | gi\|2454507\|gb\|AF009202.1AF009202 Homo sapiens YAC clone 136A2 unknown mRNA, 3'untranslated region | 3.7E−290 |
| 3534 | I:1525881:03B02:G11 | MA114:G11 | | AF368463 | gi\|14583005\|gb\|AF368463.1AF368463 Homo sapiens carboxypeptidase M mRNA, complete cds | 8.5E−176 |

TABLE 32-continued

| SEQ ID NO | Clone ID | MAClone ID | Mask Prcnt | GBHit | GBDescription | GBScore |
|---|---|---|---|---|---|---|
| 3535 | I:2071473:01A02:E05 | MA104:E05 | | X17567 | gi\|36512\|emb\|X17567.1HSSNRNPB *H. sapiens* RNA for snRNP protein B | 0 |
| 3536 | I:2481012:01A02:C11 | MA104:C11 | | BC001625 | gi\|12804436\|gb\|BC001625.1BC001625 *Homo sapiens*, Similar to for protein disulfide isomerase-related, clone MGC: 1259 IMAGE: 3537659, m | 1.6E−236 |
| 3537 | I:2816931:01B02:C11 | MA106:C11 | | D88827 | gi\|2342505\|dbj\|D88827.1D88827 *Homo sapiens* mRNA for zinc finger protein FPM315, complete cds | 4.2E−159 |
| 3538 | I:1806769:01B02:F11 | MA106:F11 | | NM_005971 | gi\|11612675\|ref\|NM_005971.2 *Homo sapiens* FXYD domain-containing ion transport regulator 3 (FXYD3), transcript variant 1, mRNA | 8.8E−242 |
| 3539 | I:2636634:04B02:A11 | MA118:A11 | | L32137 | gi\|602449\|gb\|L32137.1HUMCOMP Human germline oligomeric matrix protein (COMP) mRNA, complete cds | 2.5E−210 |
| 3540 | I:1649959:02B02:E11 | MA110:E11 | | BC002700 | gi\|12803726\|gb\|BC002700.1BC002700 *Homo sapiens*, Similar to keratin 7, clone MGC: 3625 IMAGE: 3610347, mRNA, complete cds | 2.5E−254 |
| 3541 | I:1633719:02B02:F11 | MA110:F11 | | J05428 | gi\|340079\|gb\|J05428.1HUMUDPGTA Human 3,4-catechol estrogen UDP-glucuronosyltransferase mRNA, complete cds | 3.8E−290 |
| 3542 | I:1901035:02B02:G11 | MA110:G11 | | AF081513 | gi\|5725637\|gb\|AF081513.1AF081513 *Homo sapiens* TGF-beta type secreted signaling protein LEFTYA mRNA, complete cds | 1.2E−143 |
| 3543 | I:2503879:08B01:C12 | MA133:C12 | | AF150733 | gi\|7688664\|gb\|AF150733.1AF150733 *Homo sapiens* AD-014 protein mRNA, complete cds | 3.9E−237 |
| 3544 | I:2383065:07B01:B06 | MA129:B06 | | AJ335311 | gi\|15879729\|emb\|AJ335311.1HSA335311 *Homo sapiens* genomic sequence surrounding NotI site, clone NR1-WB8C | 3.7E−50 |
| 3545 | I:3357245:07A01:F06 | MA127:F06 | | X95073 | gi\|2879814\|emb\|X95073.1HSTRAXGEN *H. sapiens* mRNA for translin associated protein X | 0 |
| 3546 | I:2832314:07A01:G06 | MA127:G06 | | M26252 | gi\|338826\|gb\|M26252.1HUMTCBA Human TCB gene encoding cytosolic thyroid hormone-binding protein, complete cds | 7.8E−279 |
| 3547 | I:3667096:07A01:D12 | MA127:D12 | | BC003412 | gi\|13097323\|gb\|BC003412.1BC003412 *Homo sapiens*, cyclophilin, clone MGC: 5016 IMAGE: 3451034, mRNA, complete cds | 1E−300 |
| 3548 | I:1798283:06A01:D06 | MA123:D06 | | BC016835 | gi\|16877126\|gb\|BC016835.1BC016835 *Homo sapiens*, Similar to synaptophysin-like protein, clone MGC: 10011 IMAGE: 3883697, mRNA, complet | 1E−300 |
| 3549 | I:1648206:03A01:B06 | MA111:B06 | | AJ420535 | gi\|17066399\|emb\|AJ420535.1HSA420535 *Homo sapiens* mRNA full length insert cDNA clone EUROIMAGE 993611 | 6.2E−264 |
| 3550 | I:3360476:03B01:B12 | MA113:B12 | | Y08768 | gi\|1877211\|emb\|Y08768.1HSIL13 *H. sapiens* mRNA for IL-13 receptor | 1.4E−177 |
| 3551 | I:2500511:03B01:C12 | MA113:C12 | | AJ001531 | gi\|2661423\|emb\|AJ001531.1HSNEUROTR *Homo sapiens* mRNA for neurotrypsin | 3.9E−265 |
| 3552 | I:1730806:03B01:D12 | MA113:D12 | | AL049705 | gi\|4678821\|emb\|AL049705.1HS262D122 Human gene from PAC 262D12, chromosome 1 | 7.8E−220 |
| 3553 | I:2479074:01B01:C06 | MA105:C06 | | AF096304 | gi\|4191395\|gb\|AF096304.1AF096304 *Homo sapiens* putative sterol reductase SR-1 (TM7SF2) mRNA, complete cds | 0 |
| 3554 | I:1635004:01B01:E06 | MA105:E06 | | BC003661 | gi\|13177786\|gb\|BC003661.1BC003661 *Homo sapiens*, lectin, galactoside-binding, soluble, 4 (galectin 4), clone MGC: 698 IMAGE: 2967411, | 4.6E−231 |
| 3555 | I:2378569:01B01:G06 | MA105:G06 | | BC000341 | gi\|12653146\|gb\|BC000341.1BC000341 *Homo sapiens*, signal sequence receptor, beta (translocon-associated protein beta), clone MGC: 8566 | 8.7E−236 |
| 3556 | I:2207849:01A01:D12 | MA103:D12 | | X65019 | gi\|33792\|emb\|X65019.1HSIL1BRNA *H. sapiens* mRNA for interleukin-1B converting enzyme | 0 |

TABLE 32-continued

| SEQ ID NO | Clone ID | MAClone ID | Mask Prcnt | GBHit | GBDescription | GBScore |
|---|---|---|---|---|---|---|
| 3557 | I:1504554:01A01:F12 | MA103:F12 | 0.1646 | U43843 | gi|1532120|gb|U43843.1HSU43843 Human h-neuro-d4 protein mRNA, complete cds | 4.6E−151 |
| 3558 | I:2989991:04B01:A06 | MA117:A06 | | AF400442 | gi|15217078|gb|AF400442.1AF400442 Homo sapiens pigment epithelium-derived factor (SERPINF1) mRNA, complete cds | 1E−300 |
| 3559 | I:2852561:04B01:B06 | MA117:B06 | | J02769 | gi|177206|gb|J02769.1HUM4F2A Human 4F2 antigen heavy chain mRNA, complete cds | 1.4E−255 |
| 3560 | I:2832839:04A01:C12 | MA115:C12 | | NM_006399 | gi|5453562|ref|NM_006399.1 Homo sapiens basic leucine zipper transcription factor, ATF-like (BATF), mRNA | 2.6E−138 |
| 3561 | I:2845548:04B01:E12 | MA117:E12 | | AY034482 | gi|15809587|gb|AY034482.1 Homo sapiens hnRNP Q2 mRNA, complete cds | 3.1E−278 |
| 3562 | I:1251819:02B01:B06 | MA109:B06 | | X78669 | gi|469884|emb|X78669.1HSERC55R H. sapiens ERC-55 mRNA | 9.1E−288 |
| 3563 | I:1672930:02B01:D06 | MA109:D06 | | X83617 | gi|620082|emb|X83617.1HSRANBP1 H. sapiens mRNA for RanBP1 | 4.7E−274 |
| 3564 | I:2122820:02B01:E06 | MA109:E06 | | BC001738 | gi|12804628|gb|BC001738.1BC001738 Homo sapiens, Similar to ubiquitin-conjugating enzyme E2G 2 (homologous to yeast UBC7), clone MGC | 3.9E−234 |
| 3565 | I:2174920:02A01:H06 | MA107:H06 | | BC006230 | gi|13623260|gb|BC006230.1BC006230 Homo sapiens, lysophospholipase-like, clone MGC: 10338 IMAGE: 3945191, mRNA, complete cds | 9.5E−260 |
| 3566 | I:1875994:05B02:E06 | MA122:E06 | | BC002638 | gi|12803606|gb|BC002638.1BC002638 Homo sapiens, hypothetical protein, clone MGC: 3365 IMAGE: 3608062, mRNA, complete cds | 2.2E−217 |
| 3567 | I:1858644:05A02:G06 | MA120:G06 | | M55268 | gi|177837|gb|M55268.1HUMA1CKII Human casein kinase 11 alpha' subunit mRNA, complete cds | 3.4E−284 |
| 3568 | I:1700047:06A02:E06 | MA124:E06 | | BC000405 | gi|12653272|gb|BC000405.1BC000405 Homo sapiens, small nuclear ribonucleoprotein polypeptide A, clone MGC: 8567 IMAGE: 2822987, mRNA, | 1.4E−224 |
| 3569 | I:1718257:06B02:E06 | MA126:E06 | | AF020760 | gi|5870864|gb|AF020760.2AF020760 Homo sapiens serine protease (OMI) mRNA, complete cds | 0 |
| 3570 | I:1612306:06A02:F06 | MA124:F06 | | BC002594 | gi|12803530|gb|BC002594.1BC002594 Homo sapiens, dolichyl-diphosphooligosaccharide-protein glycosyltransferase, clone MGC: 2191 IMAGE | 4.5E−271 |
| 3571 | I:1637427:06A02:F12 | MA124:F12 | | U31659 | gi|1136305|gb|U31659.1HSU31659 Human TBP-associated factor TAFII80 mRNA, complete cds | 7.5E−217 |
| 3572 | I:2513883:03A02:B12 | MA112:B12 | | X76717 | gi|435674|emb|X76717.1HSMT1L H. sapiens MT-11 mRNA | 2.1E−142 |
| 3573 | I:2645840:01A02:G06 | MA104:G06 | | X97795 | gi|1495482|emb|X97795.1HSRAD54 H. sapiens mRNA homologous to S. cerevisiae RAD54 | 1.7E−295 |
| 3574 | I:1737403:01A02:A12 | MA104:A12 | | Z29067 | gi|479172|emb|Z29067.1HSNEK3R H. sapiens nek3 mRNA for protein kinase | 0 |
| 3575 | I:1733522:01B02:H12 | MA106:H12 | | BC017880 | gi|17389723|gb|BC017880.1BC017880 Homo sapiens, clone MGC: 22754 IMAGE: 4277855, mRNA, complete cds | 7.7E−95 |
| 3576 | RG:160664:10006:E07 | MA155:E07 | | NM_020975 | gi|10862702|ref|NM_020975.1 Homo sapiens ret proto-oncogene (multiple endocrine neoplasia and medullary thyroid carcinoma 1, Hirsch | 1.7E−298 |
| 3577 | I:747335:16A01:E01 | MA87:E01 | | NM_000985 | gi|14591906|ref|NM_000985.2 Homo sapiens ribosomal protein L17 (RPL17), mRNA | 3.1E−272 |
| 3578 | I:2085191:16A01:H01 | MA87:H01 | | M22612 | gi|521215|gb|M22612.1HUMTRPSGNA Human pancreatic trypsin 1 (TRY1) mRNA, complete cds | 1E−287 |
| 3579 | I:1211126:16A01:E07 | MA87:E07 | | Y13901 | gi|2832349|emb|Y13901.1HSFGFR4G Homo sapiens FGFR-4 gene | 1E−300 |
| 3580 | RG:669310:10010:C01 | MA159:C01 | | BC000833 | gi|12654054|gb|BC000833.1BC000833 Homo sapiens, clone IMAGE: 3455871, mRNA, partial cds | 0 |

TABLE 32-continued

| SEQ ID NO | Clone ID | MAClone ID | Mask Prcnt | GBHit | GBDescription | GBScore |
|---|---|---|---|---|---|---|
| 3581 | RG:730402:10010:H01 | MA159:H01 | 0.225 | BC000633 | gi|12653696|gb|BC000633.1BC000633 *Homo sapiens*, TTK protein kinase, clone MGC: 865 IMAGE: 3343925, mRNA, complete cds | 2.1E−38 |
| 3582 | RG:1047541:10012:C07 | MA161:C07 | | AF156965 | gi|5731112|gb|AF156965.1AF156965 *Homo sapiens* translocon-associated protein alpha subunit mRNA, complete cds | 0 |
| 3583 | RG:1161753:10012:E07 | MA161:E07 | | X12883 | gi|30310|emb|X12883.1HSCYKT18 Human mRNA for cytokeratin 18 | 0 |
| 3584 | I:1218464:17B01:E01 | MA93:E01 | 0.47248 | | | |
| 3585 | I:958633:17B01:G07 | MA93:G07 | | AF267862 | gi|12006050|gb|AF267862.1AF267862 *Homo sapiens* DC44 mRNA, complete cds | 1.8E−180 |
| 3586 | I:1602726:09B01:B07 | MA137:B07 | 0.45675 | | | |
| 3587 | RG:205212:10007:B01 | MA156:B01 | | AF069747 | gi|4106379|gb|AF069747.1AF069747 *Homo sapiens* MTG8-like protein MTGR1a mRNA, complete cds | 6.1E−227 |
| 3588 | RG:207395:10007:B07 | MA156:B07 | | Z74616 | gi|1418929|emb|Z74616.1HSPPA2ICO *H. sapiens* mRNA for prepro-alpha2(I) collagen | 0 |
| 3589 | I:349535:16B02:G01 | MA90:G01 | 0.19957 | | | |
| 3590 | I:2323525:16A02:H01 | MA88:H01 | 0.30114 | | | |
| 3591 | I:1965049:16B02:D07 | MA90:D07 | | AF113007 | gi|6642737|gb|AF113007.1AF113007 *Homo sapiens* PRO0066 mRNA, complete cds | 4.1E−162 |
| 3592 | I:2054436:16A02:G07 | MA88:G07 | 0.15978 | | | |
| 3593 | RG:1506197:10013:F01 | MA162:F01 | | NM_052841 | gi|17017992|ref|NM_052841.2 *Homo sapiens* serine/threonine kinase 22C (spermiogenesis associated) (STK22C), mRNA | 2E−137 |
| 3594 | RG:1871436:10015:G01 | MA164:G01 | | X60489 | gi|31099|emb|X60489.1HSEF1B Human mRNA for elongation factor-1-beta | 0 |
| 3595 | RG:1705470:10015:B07 | MA164:B07 | | L38734 | gi|769675|gb|L38734.1HUMHTK *Homo sapiens* hepatoma transmembrane kinase ligand (HTK ligand) mRNA, complete cds | 2.1E−282 |
| 3596 | I:546910:17B02:B07 | MA94:B07 | | AK002212 | gi|7023953|dbj|AK002212.1AK002212 *Homo sapiens* cDNA FLJ11350 fis, clone Y79AA1001647 | 3.3E−97 |
| 3597 | I:1799023:09B02:F01 | MA138:F01 | | AK023003 | gi|10434717|dbj|AK023003.1AK023003 *Homo sapiens* cDNA FLJ12941 fis, clone NT2RP2005116, moderately similar to PUTATIVE EUKARYOTIC TR | 2.5E−164 |
| 3598 | I:2380380:09B02:H01 | MA138:H01 | | AF268037 | gi|8745546|gb|AF268037.1AF268037 *Homo sapiens* C8ORF4 protein (C8ORF4) mRNA, complete cds | 0 |
| 3599 | I:2319269:18A01:F02 | MA95:F02 | | AK022882 | gi|10434533|dbj|AK022882.1AK022882 *Homo sapiens* cDNA FLJ12820 fis, clone NT2RP2002736 | 1.1E−206 |
| 3600 | I:2296344:18A01:D08 | MA95:D08 | | AJ387747 | gi|6562532|emb|AJ387747.1HSA387747 *Homo sapiens* mRNA for sialin | 3.6E−225 |
| 3601 | RG:155066:10006:E02 | MA155:E02 | | BC018851 | gi|17402989|gb|BC018851.1BC018851 *Homo sapiens*, clone IMAGE: 3141444, mRNA | 2.2E−279 |
| 3602 | RG:180135:10006:G02 | MA155:G02 | | L37043 | gi|852056|gb|L37043.1HUMCSNK1E *Homo sapiens* casein kinase I epsilon mRNA, complete cds | 0 |
| 3603 | RG:178093:10006:F08 | MA155:F08 | | AL117430 | gi|5911865|emb|AL117430.1HSM800939 *Homo sapiens* mRNA; cDNA DKFZp434D156 (from clone DKFZp434D156); partial cds | 0 |
| 3604 | RG:184042:10006:G08 | MA155:G08 | | BC017459 | gi|16907188|gb|BC017459.1BC017459 *Homo sapiens*, clone IMAGE: 4645230, mRNA | 5.3E−240 |
| 3605 | I:1741643:16A01:A02 | MA87:A02 | | D38551 | gi|1531549|dbj|D38551.1HUMORF005 Human mRNA for KIAA0078 gene, complete cds | 1.1E−209 |
| 3606 | RG:928026:10012:B02 | MA161:B02 | | AL050147 | gi|4884153|emb|AL050147.1HSM800223 *Homo sapiens* mRNA; cDNA DKFZp586E0820 (from clone DKFZp586E0820); partial cds | 1.3E−218 |
| 3607 | RG:1032969:10012:C02 | MA161:C02 | | AF261717 | gi|8926204|gb|AF261717.1AF261717 *Homo sapiens* SAR1 (SAR1) mRNA, complete cds | 0 |

TABLE 32-continued

| SEQ ID NO | Clone ID | MAClone ID | Mask Prcnt | GBHit | GBDescription | GBScore |
|---|---|---|---|---|---|---|
| 3608 | RG:1322660:10012:H02 | MA161:H02 | | L05144 | gi\|189944\|gb\|L05144.1HUMPHOCAR Homo sapiens (clone lamda-hPEC-3) phosphoenolpyruvate carboxykinase (PCK1) mRNA, complete cds | 5.3E−283 |
| 3609 | RG:968474:10012:B08 | MA161:B08 | | Y11339 | gi\|7576275\|emb\|Y11339.2HSY11339 Homo sapiens mRNA for GalNAc alpha-2, 6-sialyltransferase I, long form | 1.7E−227 |
| 3610 | RG:1047592:10012:C08 | MA161:C08 | | X05803 | gi\|34080\|emb\|X05803.1HSKERUV Human radiated keratinocyte mRNA 266 (keratin-related protein) | 1E−300 |
| 3611 | I:617750:17B01:E08 | MA93:E08 | 0.19395 | | | |
| 3612 | I:2808775:09B01:G02 | MA137:G02 | 0.40171 | | | |
| 3613 | I:966692:18A02:B08 | MA96:B08 | 0.32029 | AK055949 | gi\|16550804\|dbj\|AK055949.1AK055949 Homo sapiens cDNA FLJ31387 fis, clone NT2NE1000018, weakly similar to SUPPRESSOR PROTEIN SRP40 | 3.7E−123 |
| 3614 | RG:209240:10007:C02 | MA156:C02 | | BC001737 | gi\|12804626\|gb\|BC001737.1BC001737 Homo sapiens, clone IMAGE: 3354010, mRNA, partial cds | 3E−192 |
| 3615 | RG:223355:10007:D02 | MA156:D02 | | Z11696 | gi\|23882\|emb\|Z11696.1HS44KDAP H. sapiens 44 kDa protein kinase related to rat ERK1 | 5.4E−252 |
| 3616 | RG:267629:10007:H02 | MA156:H02 | | U73824 | gi\|1857236\|gb\|U73824.1HSU73824 Human p97 mRNA, complete cds | 3.2E−269 |
| 3617 | I:2246234:16B02:C08 | MA90:C08 | | | | |
| 3618 | RG:1696513:10015:B02 | MA164:B02 | 0.07275 | AF377330 | gi\|14278713\|gb\|AF377330.2AF377330 Homo sapiens urokinase-type plasminogen activator (PLAU) gene, complete cds | 0 |
| 3619 | RG:1733895:10015:D02 | MA164:D02 | | BC009470 | gi\|14495716\|gb\|BC009470.1BC009470 Homo sapiens, protein kinase, interferon-inducible double stranded RNA dependent activator, clone | 0 |
| 3620 | RG:1353930:10013:A08 | MA162:A08 | | U86453 | gi\|2317893\|gb\|U86453.1HSU86453 Human phosphatidylinositol 3-kinase catalytic subunit p110delta mRNA, complete cds | 6.4E−295 |
| 3621 | RG:1881947:10015:G08 | MA164:G08 | | BC005858 | gi\|13543399\|gb\|BC005858.1BC005858 Homo sapiens, clone MGC: 3255 IMAGE: 3506187, mRNA, complete cds | 0 |
| 3622 | RG:166575:10006:F03 | MA155:F03 | | AK057849 | gi\|16553810\|dbj\|AK057849.1AK057849 Homo sapiens cDNA FLJ25120 fis, clone CBR06020 | 1E−300 |
| 3623 | I:1998994:16A01:A03 | MA87:A03 | | J04205 | gi\|178686\|gb\|J04205.1HUMANTLAA Human La protein mRNA, complete cds | 1.6E−258 |
| 3624 | I:1953051:16A01:D03 | MA87:D03 | | BC004138 | gi\|13278716\|gb\|BC004138.1BC004138 Homo sapiens, ribosomal protein L6, clone MGC: 1635 IMAGE: 2823733, mRNA, complete cds | 2E−276 |
| 3625 | I:518826:16A01:E03 | MA87:E03 | | BC007771 | gi\|14043585\|gb\|BC007771.1BC007771 Homo sapiens, dual specificity phosphatase 2, clone MGC: 12703 IMAGE: 4297852, mRNA, complete cds | 2.8E−266 |
| 3626 | I:81490:16A01:B09 | MA87:B09 | | BC007942 | gi\|14044027\|gb\|BC007942.1BC007942 Homo sapiens, nucleolar autoantigen (55 kD) similar to rat synaptonemal complex protein, clone MGC | 1.9E−270 |
| 3627 | RG:1256163:10012:F03 | MA161:F03 | | M36501 | gi\|177871\|gb\|M36501.1HUMA2MGL Human alpha-2-macroglobulin mRNA, 3' end | 1E−300 |
| 3628 | RG:1132085:10012:D09 | MA161:D09 | | BC006510 | gi\|13676353\|gb\|BC006510.1BC006510 Homo sapiens, Similar to cyclin B1, related sequence 1, clone MGC: 2548 IMAGE: 2963100, mRNA, compl | 0 |
| 3629 | I:2132717:17B01:C09 | MA93:C09 | | AB058749 | gi\|14017908\|dbj\|AB058749.1AB058749 Homo sapiens mRNA for KIAA1846 protein, partial cds | 3.8E−256 |
| 3630 | I:1998428:17B01:F09 | MA93:F09 | | AF115926 | gi\|17998664\|gb\|AF115926.1AF115926 Homo sapiens XAG-2 homolog long protein (HPC8) mRNA, complete cds | 6.9E−208 |
| 3631 | RG:206694:10007:B03 | MA156:B03 | | X00588 | gi\|31113\|emb\|X00588.1HSEGFPRE Human mRNA for precursor of epidermal growth factor receptor | 1E−300 |
| 3632 | RG:261714:10007:F09 | MA156:F09 | | AF116618 | gi\|7959738\|gb\|AF116618.1AF116618 Homo sapiens PRO1038 mRNA, complete cds | 0 |

TABLE 32-continued

| SEQ ID NO | Clone ID | MAClone ID | Mask Prcnt | GBHit | GBDescription | GBScore |
|---|---|---|---|---|---|---|
| 3633 | I:1461515:16A02:C03 | MA88:C03 | 0.3525 | | | |
| 3634 | I:338859:16A02:H03 | MA88:H03 | 0.27273 | | | |
| 3635 | I:1425861:16A02:G09 | MA88:G09 | 0.4929 | | | |
| 3636 | I:1928644:16B02:H09 | MA90:H09 | 0.34967 | AK055711 | gi|16550506|dbj|AK055711.1AK055711 Homo sapiens cDNA FLJ31149 fis, clone IMR322001491, moderately similar to Rattus norvegicus tric | 7.1E−131 |
| 3637 | RG:1404414:10013:C03 | MA162:C03 | | U01038 | gi|393016|gb|U01038.1HSU01038 Human pLK mRNA, complete cds | 6.5E−277 |
| 3638 | RG:1415437:10013:D03 | MA162:D03 | | BG001190 | gi|12654700|gb|BC001190.1BC001190 Homo sapiens, Similar to creatine kinase, brain, clone MGC: 3160 IMAGE: 3354679, mRNA, complete cds | 0 |
| 3639 | RG:1734353:10015:D03 | MA164:D03 | | BC002555 | gi|12803460|gb|BC002555.1BC002555 Homo sapiens, CDC-like kinase 3, clone MGC: 1777 IMAGE: 3138580, mRNA, complete cds | 0 |
| 3640 | RG:1872251:10015:G03 | MA164:G03 | | Y17151 | gi|4826562|emb|Y17151.2HSY17151 Homo sapiens mRNA for multidrug resistance protein 3 (ABCC3) | 1.7E−31 |
| 3641 | RG:1354408:10013:A09 | MA162:A09 | | AF257466 | gi|8453155|gb|AF257466.1AF257466 Homo sapiens N-acetylneuraminic acid phosphate synthase mRNA, complete cds | 3.7E−290 |
| 3642 | RG:1690198:10015:A09 | MA164:A09 | | X90563 | gi|1480099|emb|X90563.1HSPPARGAM H. sapiens mRNA for peroxisome proliferactor activated receptor gamma | 0 |
| 3643 | RG:1476452:10013:E09 | MA162:E09 | | BC007276 | gi|13938296|gb|BC007276.1BC007276 Homo sapiens, Similar to heat shock cognate 71-kd protein, clone MGC: 15597 IMAGE: 3162067, mRNA, c | 1E−300 |
| 3644 | I:2069305:09B02:F03 | MA138:F03 | | BC015139 | gi|15929410|gb|BC015139.1BC015139 Homo sapiens, clone IMAGE: 4040789, mRNA, partial cds | 0 |
| 3645 | I:1966067:18B01:H04 | MA97:H04 | | AF062916 | gi|3941523|gb|AF062916.1AF062916 Arabidopsis thaliana putative transcription factor (MYB92) mRNA, complete cds | 3.6E−22 |
| 3646 | I:2128547:18B01:A10 | MA97:A10 | | AF151839 | gi|4929630|gb|AF151839.1AF151839 Homo sapiens CGI-81 protein mRNA, complete cds | 4.6E−268 |
| 3647 | RG:149960:10006:D04 | MA155:D04 | | BC017483 | gi|17028354|gb|BC017483.1BC017483 Homo sapiens, clone IMAGE: 3506553, mRNA | 3.9E−237 |
| 3648 | RG:171569:10006:F04 | MA155:F04 | | M64174 | gi|190734|gb|M64174.1HUMPTKJAK1 Human protein-tyrosine kinase (JAK1) mRNA, complete cds | 1E−300 |
| 3649 | RG:178638:10006:F10 | MA155:F10 | | BC004408 | gi|13325179|gb|BC004408.1BC004408 Homo sapiens, Similar to high-mobility group 20B, clone MGC: 11001 IMAGE: 3638942, mRNA, complete c | 1.1E−225 |
| 3650 | RG:195122:10006:H10 | MA155:H10 | | Z11695 | gi|23878|emb|Z11695.1HS40KDAP H. sapiens 40 kDa protein kinase related to rat ERK2 | 4.3E−271 |
| 3651 | I:814216:16A01:F10 | MA87:F10 | | BC006395 | gi|13623564|gb|BC006395.1BC006395 Homo sapiens, cell division cycle 25B, clone MGC: 12797 IMAGE: 4135465, mRNA, complete cds | 9.3E−254 |
| 3652 | RG:491163:10010:A04 | MA159:A04 | | BC008767 | gi|14250615|gb|BC008767.1BC008767 Homo sapiens, Similar to acyl-Coenzyme A oxidase 1, palmitoyl, clone MGC: 1198 IMAGE: 3051501, mRNA | 9.3E−232 |
| 3653 | RG:827185:10012:A04 | MA161:A04 | | AK055642 | gi|16550422|dbj|AK055642.1AK055642 Homo sapiens cDNA FLJ31080 fis, clone HSYRA2001615, highly similar to Sus scrofa calcium/calmodu | 2.5E−251 |
| 3654 | RG:1129102:10012:D04 | MA161:D04 | | NM_000975 | gi|15431289|ref|NM_000975.2 Homo sapiens ribosomal protein L11 (RPL11), mRNA | 1E−300 |
| 3655 | RG:730938:10010:H04 | MA159:H04 | | BC000580 | gi|12653606|gb|BC000580.1BC000580 Homo sapiens, clone IMAGE: 3162218, mRNA, partial cds | 2.1E−254 |
| 3656 | RG:925984:10012:A10 | MA161:A10 | | J03358 | gi|339714|gb|J03358.1HUMTKFER Human tyrosine kinase (FER) mRNA, complete cds | 1.2E−246 |

TABLE 32-continued

| SEQ ID NO | Clone ID | MAClone ID | Mask Prcnt | GBHit | GBDescription | GBScore |
|---|---|---|---|---|---|---|
| 3657 | RG:668442:10010:B10 | MA159:B10 | | X74764 | gi|433337|emb|X74764.1HSRPTK H. sapiens mRNA for receptor protein tyrosine kinase | 0 |
| 3658 | RG:1028911:10012:B10 | MA161:B10 | | U88666 | gi|1857943|gb|U88666.1HSU88666 Homo sapiens serine kinase SRPK2 mRNA, complete cds | 1E−300 |
| 3659 | RG:684866:10010:C10 | MA159:C10 | | X51521 | gi|31282|emb|X51521.1HSEZRIN Human mRNA for ezrin | 1E−293 |
| 3660 | RG:1283076:10012:F10 | MA161:F10 | | BC007888 | gi|14043894|gb|BC007888.1BC007888 Homo sapiens, eukaryotic translation initiation factor 2, subunit 2 (beta, 38 kD), clone MGC: 1417 | 0 |
| 3661 | I:627654:17A01:G04 | MA91:G04 | | AF081192 | gi|3420798|gb|AF081192.1AF081192 Homo sapiens histone H2A.F/Z variant (H2AV) mRNA, complete cds | 0 |
| 3662 | I:1833801:17A01:D10 | MA91:D10 | | BC009836 | gi|14602636|gb|BC009836.1BC009836 Homo sapiens, clone MGC: 15133 IMAGE: 4098463, mRNA, complete cds | 1.9E−270 |
| 3663 | I:961473:17B01:H10 | MA93:H10 | 0.20615 | AK024678 | gi|10437017|dbj|AK024678.1AK024678 Homo sapiens cDNA: FLJ21025 fis, clone CAE06758 | 2.7E−117 |
| 3664 | I:2556708:09B01:B10 | MA137:B10 | | BC018807 | gi|17402954|gb|BC018807.1BC018807 Homo sapiens, clone IMAGE: 4861487, mRNA | 1.6E−55 |
| 3665 | RG:243565:10007:D10 | MA156:D10 | | AF015254 | gi|4090840|gb|AF015254.1AF015254 Homo sapiens serine/threonine kinase (STK-1) mRNA, complete cds | 8.4E−186 |
| 3666 | RG:266649:10007:G10 | MA156:G10 | | AB034951 | gi|11526572|dbj|A8034951.1AB034951 Homo sapiens HSC54 mRNA for heat shock cognate protein 54, complete cds | 1E−300 |
| 3667 | I:2013513:16B02:B04 | MA90:B04 | | AF155913 | gi|6435129|gb|AF155913.1AF155913 Mus musculus putative E1-E2 ATPase mRNA, complete cds | 3.7E−51 |
| 3668 | I:2312442:16A02:B10 | MA88:B10 | 0.38737 | AK021945 | gi|10433249|dbj|AK021945.1AK021945 Homo sapiens cDNA FLJ11883 fis, clone HEMBA1007178 | 1.9E−131 |
| 3669 | I:2060626:16A02:D10 | MA88:D10 | | AK055800 | gi|16550622|dbj|AK055800.1AK055800 Homo sapiens cDNA FLJ31238 fis, clone KIDNE2004864 | 1.1E−191 |
| 3670 | RG:1415858:10013:D04 | MA162:D04 | | D85759 | gi|1526445|dbj|D85759.1D85759 Homo sapiens mRNA for MNB protein kinase, complete cds | 4.8E−271 |
| 3671 | RG:1517435:10013:F04 | MA162:F04 | | X13546 | gi|32328|emb|X13546.1HSHMG17G Human HMG-17 gene for non-histone chromosomal protein HMG-17 | 6.7E−292 |
| 3672 | RG:1914716:10015:H04 | MA164:H04 | | X13697 | gi|36414|emb|X13697.1HSSBLA Human mRNA for ribonucleoprotein SS-B/La | 1E−300 |
| 3673 | RG:1354528:10013:A10 | MA162:A10 | | AF197898 | gi|6166494|gb|AF197898.1AF197898 Homo sapiens nemo-like kinase mRNA, complete cds | 6.7E−298 |
| 3674 | RG:1706414:10015:B10 | MA164:B10 | | M36501 | gi|177871|gb|M36501.1HUMA2MGL Human alpha-2-macroglobulin mRNA, 3' end | 0 |
| 3675 | I:1998510:17A02:C04 | MA92:C04 | | BC004872 | gi|13436100|gb|BC004872.1BC004872 Homo sapiens, clone MGC: 11034 IMAGE: 3677618, mRNA, complete cds | 1.4E−252 |
| 3676 | I:899118:17B02:G10 | MA94:G10 | | AK055564 | gi|16550323|dbj|AK055564.1AK0555.64 Homo sapiens cDNA FLJ31002 fis, clone HLUNG2000004 | 4E−159 |
| 3677 | I:2680168:09B02:B04 | MA138:B04 | | AL050071 | gi|4884302|emb|AL050071.1HSM800396 Homo sapiens mRNA; cDNA DKFZp566B0846 (from clone DKFZp566B0846); partial cds | 0 |
| 3678 | I:1354558:09B02:E04 | MA138:E04 | | AK054675 | gi|16549267|dbj|AK054675.1AK054675 Homo sapiens cDNA FLJ30113 fis, clone BNGH42000474 | 1E−156 |
| 3679 | I:1665871:09B02:F10 | MA138:F10 | | AF288394 | gi|12620197|gb|AF288394.1AF288394 Homo sapiens C1orf19 mRNA, partial cds | 0 |
| 3680 | I:1922084:18B01:C05 | MA97:C05 | | AK000057 | gi|7019894|dbj|AK000057.1AK000057 Homo sapiens cDNA FLJ20050 fis, clone COL00688 | 1.3E−246 |
| 3681 | I:2307946:18A01:B11 | MA95:B11 | | BC016150 | gi|16740553|gb|BC016150.1BC016150 Homo sapiens, Similar to CAP-binding protein complex interacting protein 2, clone IMAGE: 3637027, | 8.9E−226 |

TABLE 32-continued

| SEQ ID NO | Clone ID | MAClone ID | Mask Prcnt | GBHit | GBDescription | GBScore |
|---|---|---|---|---|---|---|
| 3682 | I:1923572:18B01:C11 | MA97:C11 | | AL049959 | gi\|4884211\|emb\|AL049959.1HSM800304 *Homo sapiens* mRNA; cDNA DKFZp564K1023 (from clone DKFZp564K1023) | 2.3E−154 |
| 3683 | RG:171993:10006:F05 | MA155:F05 | 0.31835 | AK057735 | gi\|16553657\|dbj\|AK057735.1AK057735 *Homo sapiens* cDNA FLJ25006 fis, clone CBL00989 | 3.9E−142 |
| 3684 | RG:129317:10006:B11 | MA155:B11 | | AF103796 | gi\|4185795\|gb\|AF103796.1AF103796 *Homo sapiens* placenta-specific ATP-binding cassette transporter (ABCP) mRNA, complete cds | 1E−300 |
| 3685 | RG:153244:10006:D11 | MA155:D11 | | L06139 | gi\|292823\|gb\|L06139.1HUMTEKRPTK *Homo sapiens* receptor protein-tyrosine kinase (TEK) mRNA, complete cds | 1.1E−299 |
| 3686 | RG:196236:10006:H11 | MA155:H11 | | AF359246 | gi\|13991617\|gb\|AF359246.1AF359246 *Homo sapiens* fibroblast growth factor receptor 4 variant mRNA, complete cds | 5E−249 |
| 3687 | I:557538:16A01:C11 | MA87:C11 | | BC013142 | gi\|15341912\|gb\|BC013142.1BC013142 *Homo sapiens*, interleukin 1, alpha, clone MGC: 9225 IMAGE: 3875617, mRNA, complete cds | 1.1E−240 |
| 3688 | I:782235:16A01:F11 | MA87:F11 | | K01228 | gi\|180391\|gb\|K01228.1HUMCG1PA1 Human proalpha 1 (I) chain of type I procollagen mRNA (partial) | 9E−251 |
| 3689 | RG:1257341:10012:F05 | MA161:F05 | | BC007952 | gi\|14044057\|gb\|BC007952.1BC007952 *Homo sapiens*, pyruvate kinase, muscle, clone MGC: 14360 IMAGE: 4299213, mRNA, complete cds | 1E−300 |
| 3690 | RG:727387:10010:G05 | MA159:G05 | | BC001413 | gi\|13937593\|gb\|BC001413.1BC001413 *Homo sapiens*, clone IMAGE: 3140866, mRNA | 0 |
| 3691 | RG:1145235:10012:D11 | MA161:D11 | | BC007540 | gi\|14043108\|gb\|BC007540.1BC007540 *Homo sapiens*, clone IMAGE: 3609337, mRNA, partial cds | 3.4E−71 |
| 3692 | RG:725145:10010:F11 | MA159:F11 | | AJ000512 | gi\|2463200\|emb\|AJ000512.1HSSGK *Homo sapiens* sgk gene | 8.4E−264 |
| 3693 | RG:740079:10010:H11 | MA159:H11 | | M14505 | gi\|456426\|gb\|M14505.1HUMCDPK Human (clone PSK-J3) cyclin-dependent protein kinase mRNA, complete cds., | 0 |
| 3694 | I:1873176:09B01:E05 | MA137:E05 | | BC001909 | gi\|12804912\|gb\|BC001909.1BC001909 *Homo sapiens*, clone IMAGE: 3537447, mRNA, partial cds | 0 |
| 3695 | I:2081974:09B01:D11 | MA137:D11 | | AK057078 | gi\|16552660\|dbj\|AK057078.1AK057078 *Homo sapiens* cDNA FLJ32516 fis, clone SMINT1000103, highly similar to *Homo sapiens* ankyrin repea | 0 |
| 3696 | I:2107723:18A02:G05 | MA96:G05 | | AK000193 | gi\|7020116\|dbj\|AK000193.1AK000193 *Homo sapiens* cDNA FLJ20186 fis, clone COLF0428 | 1.2E−265 |
| 3697 | RG:207777:10007:B11 | MA156:B11 | | X04714 | gi\|28779\|emb\|X04714.1HSAPOB10 Human mRNA for apolipoprotein B-100 (apoB-100) | 1E−300 |
| 3698 | RG:221172:10007:C11 | MA156:C11 | | M14333 | gi\|181171\|gb\|M14333.1HUMCSYNA *Homo sapiens* c-syn protooncogene mRNA, complete cds | 2.2E−97 |
| 3699 | I:1968436:16B02:C05 | MA90:C05 | 0.33281 | | | |
| 3700 | I:2060973:16A02:G11 | MA88:G11 | | AB035384 | gi\|7619897\|dbj\|AB035384.1AB035384 *Homo sapiens* mRNA for SRp25 nuclear protein, complete cds | 2.6E−291 |
| 3701 | RG:1369494:10013:B05 | MA162:B05 | | AF008552 | gi\|2979629\|gb\|AF008552.1AF008552 *Homo sapiens* aurora-related kinase 2 (ARK2) mRNA, complete cds | 1E−300 |
| 3702 | RG:1752177:10015:E05 | MA164:E05 | | | | |
| 3703 | RG:1519327:10013:F05 | MA162:F05 | | X66364 | gi\|36620\|emb\|X66364.1HSSTHPKE *H. sapiens* mRNA PSSALRE for serine/threonine protein kinase | 0 |
| 3704 | RG:1694569:10015:A11 | MA164:A11 | | X06323 | gi\|34753\|emb\|X06323.1HSMRL3R Human MRL3 mRNA for ribosomal protein L3 homologue (MRL3 = mammalian ribosome L3) | 0 |
| 3705 | RG:1839794:10015:E11 | MA164:E11 | | U28387 | gi\|881950\|gb\|U28387.1HSU28387 Human hexokinase II pseudogene, complete cds | 5.2E−175 |

TABLE 32-continued

| SEQ ID NO | Clone ID | MAClone ID | Mask Prcnt | GBHit | GBDescription | GBScore |
|---|---|---|---|---|---|---|
| 3706 | I:514124:17A02:D05 | MA92:D05 | | AJ420434 | gi\|17066298\|emb\|AJ420434.1HSA420434 *Homo sapiens* mRNA full length insert cDNA clone EUROIMAGE 1499812 | 6.5E−114 |
| 3707 | I:997782:17A02:G05 | MA92:G05 | | AB018346 | gi\|3882326\|dbj\|AB018346.1AB018346 *Homo sapiens* mRNA for KIAA0803 protein, partial cds | 2.8E−185 |
| 3708 | I:1709364:09B02:F11 | MA138:F11 | | NM_018440 | gi\|16753228\|ref\|NM_018440.2 *Homo sapiens* phosphoprotein associated with glycosphingolipid-enriched microdomains (PAG), mRNA | 6.4E−180 |
| 3709 | I:2004896:18A01:C06 | MA95:C06 | | AK023512 | gi\|10435467\|dbj\|AK023512.1AK023512 *Homo sapiens* cDNA FLJ13450 fis, clone PLACE1003027, highly similar to *Homo sapiens* mRNA for KIAA | 2E−117 |
| 3710 | RG:172982:10006:F06 | MA155:F06 | | D83492 | gi\|2281007\|dbj\|D83492.1D83492 *Homo sapiens* mRNA for Eph-family protein, complete cds | 0 |
| 3711 | RG:180978:10006:G06 | MA155:G06 | | D83492 | gi\|2281007\|dbj\|D83492.1D83492 *Homo sapiens* mRNA for Eph-family protein, complete cds | 0 |
| 3712 | RG:129528:10006:B12 | MA155:B12 | | U00238 | gi\|404860\|gb\|U00238.1U00238 *Homo sapiens* glutamine PRPP amidotransferase (GPAT) mRNA, complete cds | 1.6E−286 |
| 3713 | RG:186511:10006:G12 | MA155:G12 | | AK000250 | gi\|7020204\|dbj\|AK000250.1AK000250 *Homo sapiens* cDNA FLJ20243 fis, clone COLF6418, highly similar to NUCL_HUMAN NUCLEOLIN | 3.4E−204 |
| 3714 | I:2005910:16B01:B06 | MA89:B06 | | AJ340058 | gi\|15884476\|emb\|AJ340058.1HSA340058 *Homo sapiens* genomic sequence surrounding NotI site, clone NR5-ID23C | 2.8E−110 |
| 3715 | I:620871:16A01:D06 | MA87:D06 | | BC007422 | gi\|13938544\|gb\|BC007422.1BC007422 *Homo sapiens*, acid phosphatase 1, soluble, clone MGC: 3499 IMAGE: 3027769, mRNA, complete cds | 3.5E−250 |
| 3716 | I:1920819:16A01:A12 | MA87:A12 | | BC015123 | gi\|15929378\|gb\|BC015123.1BC015123 *Homo sapiens*, Similar to retinoblastoma-binding protein 4, clone IMAGE: 3686783, mRNA, partial cds | 8.2E−276 |
| 3717 | I:990375:16A01:E12 | MA87:E12 | | M10050 | gi\|182355\|gb\|M10050.1HUMFABPL Human liver fatty acid binding protein (FABP) mRNA, complete cds | 1.8E−267 |
| 3718 | I:690313:16A01:G12 | MA87:G12 | | BC017201 | gi\|16877960\|gb\|BC017201.1BC017201 *Homo sapiens*, insulin-like growth factor binding protein 7, clone MGC: 3699 IMAGE: 3632247, mRNA, c | 3.8E−200 |
| 3719 | RG:878195:10012:A06 | MA161:A06 | | M83653 | gi\|179635\|gb\|M83653.1HUMC1PHTYR *Homo sapiens* cytoplasmic phosphotyrosyl protein phosphatase (clone type 1) complete cds | 0 |
| 3720 | RG:687128:10010:D06 | MA159:D06 | | S75546 | gi\|914097\|gb\|S75546.1S75546 protein kinase PRK1 [human, fetal brain, mRNA, 3001 nt] | 1.7E−38 |
| 3721 | I:884855:17B01:D06 | MA93:D06 | | AK055393 | gi\|16550110\|dbj\|AK055393.1AK055393 *Homo sapiens* cDNA FLJ30831 fis, clone FEBRA2001989 | 4E−228 |
| 3722 | I:1218621:17B01:F06 | MA93:F06 | | | | |
| 3723 | I:620371:17A01:H06 | MAA91:H06 | | BC016472 | gi\|16741273\|gb\|BC016472.1BC016472 *Homo sapiens*, clone MGC: 17244 IMAGE: 4178911, mRNA, complete cds | 1E−203 |
| 3724 | I:1681610:09B01:D06 | MA137:D06 | | AK055827 | gi\|16550653\|dbj\|AK055827.1AK055827 *Homo sapiens* cDNA FLJ31265 fis, clone KIDNE2006030, moderately similar to *Gallus gallus* syndesmo | 1.3E−124 |
| 3725 | RG:265206:10007:G06 | MA156:G06 | | U25975 | gi\|984304\|gb\|U25975.1HSU25975 Human serine kinase (hPAK65) mRNA, partial cds | 1E−231 |
| 3726 | RG:268073:10007:H06 | MA156:H06 | | AF226044 | gi\|9295326\|gb\|AF226044.1AF226044 *Homo sapiens* HSNFRK (HSNFRK) mRNA, complete cds | 9.8E−118 |
| 3727 | I:2117221:16A02:F06 | MA88:F06 | 0.22151 | AF130089 | gi\|11493482\|gb\|AF130089.1AF130089 *Homo sapiens* clone FLB9440 PRO2550 mRNA, complete cds | 9.5E−152 |
| 3728 | I:1760693:16B02:G06 | MA90:G06 | | | | |
| 3729 | I:776793:16B02:B12 | MA90:B12 | | AF086524 | gi\|3483869\|gb\|AF086524.1HUMZE04F10 *Homo sapiens* full length insert cDNA clone ZE04F10 | 1.5E−283 |

TABLE 32-continued

| SEQ ID NO | Clone ID | MAClone ID | Mask Prcnt | GBHit | GBDescription | GBScore |
|---|---|---|---|---|---|---|
| 3730 | RG:1405692:l0013:C06 | MA162:C06 | | X60489 | gi|31099|emb|X60489.1HSEF1B Human mRNA for elongation factor-1-beta | 0 |
| 3731 | RG:1707747:l0015:B12 | MA164:B12 | | M29536 | gi|182066|gb|M29536.1HUMELF2 Human translational initiation factor 2 beta subunit (eIF-2-beta) mRNA, complete cds | 0 |
| 3732 | RG:1722789:l0015:C12 | MA164:C12 | | AF183421 | gi|9963780|gb|AF183421.1AF183421 Homo sapiens small GIP-binding protein rab22b mRNA, complete cds | 0 |
| 3733 | I:2112348:17B02:E06 | MA94:E06 | | AK026529 | gi|10439407|dbj|AK026529.1AK026529 Homo sapiens cDNA: FLJ22876 fis, clone KAT02954, highly similar to AF056183 Homo sapiens WS beta | 1.7E−196 |
| 3734 | I:630458:17A02:F06 | MA92:F06 | | AK025537 | gi|10438082|dbj|AK025537.1AK025537 Homo sapiens cDNA: FLJ21884 fis, clone HEP02863 | 7.2E−211 |
| 3735 | I:901577:17A02:H06 | MA92:H06 | | AK000771 | gi|7021067|dbj|AK000771.1AK000771 Homo sapiens cDNA FLJ20764 fis, clone COL08503 | 2.3E−195 |
| 3736 | I:2298081:17B02:E12 | MA94:E12 | | AL080169 | gi|5262637|emb|AL080169.1HSM800688 Homo sapiens mRNA; cDNA DKFZp434C171 (from clone DKFZp434C171); partial cds | 0 |
| 3737 | I:2718565:09B02:H12 | MA138:H12 | | AF207600 | gi|9998951|gb|AF207600.2AF207600 Homo sapiens ethanolamine kinase (EMI1) mRNA, complete cds | 3.2E−253 |
| 3738 | M00056237C:E03 | MA181:A01 | 0.8773 | U27317 | gi|9989705|gb|U27317.2HSHSD11K1 Homo sapiens 11 beta-hydroxysteroid dehydrogenase 2 (HSD11B2) gene, complete cds | 7.9E−23 |
| 3739 | M00055261C:F04 | MA197:E01 | | NM_033643 | gi|16117795|ref|NM_033643.1 Homo sapiens ribosomal protein L36 (RPL36), transcript variant 1, mRNA | 8.3E−223 |
| 3740 | M00055353D:A04 | MA197:D07 | | BC006794 | gi|13905021|gb|BC006794.1BC006794 Homo sapiens, Similar to interferon induced transmembrane protein 3 (1-8U), clone MGC: 5225 IMAGE: | 1.1E−156 |
| 3741 | M00055357B:B10 | MA197:H07 | | BC006794 | gi|13905021|gb|BC006794.1BC006794 Homo sapiens, Similar to interferon induced transmembrane protein 3 (1-8U), clone MGC: 5225 IMAGE: | 3E−275 |
| 3742 | M00056386D:H12 | MA173:C01 | | BC007700 | gi|14712760|gb|BC007700.1BC007700 Homo sapiens, clone IMAGE: 3954272, mRNA | 6.1E−180 |
| 3743 | M00056394B:B04 | MA173:D01 | | BC006791 | gi|13905015|gb|BC006791.1BC006791 Homo sapiens, ribosomal protein L10a, clone MGC: 5203 IMAGE: 2901249, mRNA, complete cds | 1E−175 |
| 3744 | M00056395A:B04 | MA173:E01 | | BC016835 | gi|16877126|gb|BC016835.1BC016835 Homo sapiens, Similar to synaptophysin-like protein, clone MGC: 10011 IMAGE: 3883697, mRNA, complet | 4.2E−55 |
| 3745 | M00056396B:G05 | MA173:F01 | | AK026171 | gi|10439934|dbj|AK026171.1AK026171 Homo sapiens cDNA: FLJ22518 fis, clone HRC12216, highly similar to AF151069 Homo sapiens HSPC235 | 2.9E−94 |
| 3746 | M00056137A:A05 | MA180:G01 | | | | |
| 3747 | M00056401C:C03 | MA173:H01 | | L20688 | gi|404044|gb|L20688.1HUMLYGDI Human GDP-dissociation inhibitor protein (Ly-GDI) mRNA, complete cds | 6.4E−267 |
| 3748 | M00056484A:F06 | MA173:E07 | | NM_003145 | gi|6552341|ref|NM_003145.2 Homo sapiens signal sequence receptor, beta (translocon-associated protein beta) (SSR2), mRNA | 1.3E−252 |
| 3749 | M00056193B:C11 | MA180:F07 | | AF119905 | gi|7770246|gb|AF119905.1AF119905 Homo sapiens PRO2853 mRNA, complete cds | 4.6E−193 |
| 3750 | M00056484B:B07 | MA173:G07 | | AF203815 | gi|6979641|gb|AF203815.1AF203815 Homo sapiens alpha gene sequence | 6.6E−214 |
| 3751 | M00056193B:D06 | MA180:G07 | | AF004162 | gi|3046385|gb|AF004162.1AF004162 Homo sapiens nickel-specific induction protein (Cap43) mRNA, complete cds | 8.3E−201 |
| 3752 | M00056194B:G06 | MA180:H07 | | BC016834 | gi|16877123|gb|BC016834.1BC016834 Homo sapiens, clone IMAGE: 3883264, mRNA, partial cds | 2.5E−294 |

TABLE 32-continued

| SEQ ID NO | Clone ID | MAClone ID | Mask Prcnt | GBHit | GBDescription | GBScore |
|---|---|---|---|---|---|---|
| 3753 | M00054633D:B07 | MA187:A01 | | BC018210 | gi\|17390469\|gb\|BC018210.1BC018210 *Homo sapiens*, tubulin-specific chaperone a, clone MGC: 9129 IMAGE: 3861138, mRNA, complete cds | 7.9E−279 |
| 3754 | M00054633D:E06 | MA187:B01 | | X52003 | gi\|311379\|emb\|X52003.1HSPS2MKN *H. sapiens* pS2 protein gene | 3E−275 |
| 3755 | M000548458A:C03 | MA189:H01 | | NM_001010 | gi\|17158043\|ref\|NM_001010.2 *Homo sapiens* ribosomal protein S6 (RPS6), mRNA | 3.6E−287 |
| 3756 | M00054882C:C06 | MA189:A07 | | BC000915 | gi\|14705283\|gb\|BC000915.2BC000915 *Homo sapiens*, PDZ and LIM domain 1 (elfin), clone MGC: 5344 IMAGE: 2985229. mRNA, complete cds | 5.3E−283 |
| 3757 | M00054678D:A03 | MA187:B07 | | BC015564 | gi\|15990405\|gb\|BC015564.1BC015564 *Homo sapiens*, cold shock domain protein A, clone MGC: 12695 IMAGE: 4137643, mRNA, complete cds | 7.8E−279 |
| 3758 | M00054679B:B03 | MA187:D07 | | BC015642 | gi\|15990506\|gb\|BC015642.1BC015642 *Homo sapiens*, Similar to serine (or cysteine) proteinase inhibitor, clade A (alpha-1 antiproteina | 4.8E−277 |
| 3759 | M00054680B:D06 | MA187:G07 | | BC009623 | gi\|16307089\|gb\|BC009623.1BC009623 *Homo sapiens*, Similar to nucleophosmin (nucleolar phosphoprotein B23, numatrin), clone MGC: 17308 | 8.4E−279 |
| 3760 | M00054680C:A06 | MA187:H07 | | U28387 | gi\|881950\|gb\|U28387.1HSU28387 Human hexokinase II pseudogene, complete cds | 9E−83 |
| 3761 | M00057176B:F11 | MA193:B01 | | BC000419 | gi\|12653300\|gb\|BC000419.1BC000419 *Homo sapiens*, catechol-O-methyltransferase, clone MGC: 8663 IMAGE: 2964400, mRNA, complete cds | 1.1E−296 |
| 3762 | M00057181A:D01 | MA193:C01 | | AY008283 | gi\|15192138\|gb\|AY008283.1 *Homo sapiens* porimin mRNA, complete cds | 4.9E−196 |
| 3763 | M00057219D:B04 | MA193:D07 | | NM_001015 | gi\|14277698\|ref\|NM_001015.2 *Homo sapiens* ribosomal protein S11 (RPS11), mRNA | 3.4E−175 |
| 3764 | M00042341A:D12 | MA167:A01 | | NM_002153 | gi\|4504502\|ref\|NM_002153.1 *Homo sapiens* hydroxysteroid (17-beta) dehydrogenase 2 (HSD17B2), mRNA | 8.3E−123 |
| 3765 | M00042433B:G09 | MA171:B01 | | AJ295637 | gi\|9581767\|emb\|AJ295637.1HSA295637 *Homo sapiens* mRNA for URIM protein | 1.2E−221 |
| 3766 | M00042435A:F08 | MA171:D01 | | BC014048 | gi\|15559357\|gb\|BC014048.1BC014048 *Homo sapiens*, clone IMAGE: 3348134, mRNA, partial cds | 4.6E−122 |
| 3767 | M00042437B:G03 | MA171:E01 | | X59315 | gi\|33247\|emb\|X59315.1HSIGKL012 *H. sapiens* gene for Ig kappa light chain variable region "012" | 1.5E−119 |
| 3768 | M00042525D:E07 | MA167:F01 | | BC005982 | gi\|13543665\|gb\|BC005982.1BC005982 *Homo sapiens*, peptidylprolyl isomerase A (cyclophilin A), clone MGC: 14681 IMAGE: 4109260, mRNA, co | 1.4E−105 |
| 3769 | M00042438B:D01 | MA171:F01 | | NM_004063 | gi\|16507959\|ref\|NM_004063.2 *Homo sapiens* cadherin 17, LI cadherin (liver-intestine) (CDH17), mRNA | 6.1E−264 |
| 3770 | M00042529C:G07 | MA167:G01 | | L02785 | gi\|291963\|gb\|L02785.1HUMDRA *Homo sapiens* colon mucosa-associated (DRA) mRNA, complete cds | 5.8E−261 |
| 3771 | M00042529D:B12 | MA167:H01 | 0.07368 | BC007011 | gi\|13937818\|gb\|BC007011.1BC007011 *Homo sapiens*, clone MGC: 12335 IMAGE: 3686576, mRNA, complete cds | 2.1E−145 |
| 3772 | M00042700A:E05 | MA167:A07 | | U07550 | gi\|469170\|gb\|U07550.1HSU07550 1 Human chaperonin 10 mRNA, complete cds | 4.1E−212 |
| 3773 | M00042777D:G05 | MA171:B07 | | AY007243 | gi\|12621025\|gb\|AY007243.1 *Homo sapiens* regenerating gene type IV mRNA, complete cds | 6.1E−264 |
| 3774 | M00042781C:F03 | MA171:D07 | | BC016753 | gi\|16876954\|gb\|BC016753.1BC016753 *Homo sapiens*, clone MGC: 1138 IMAGE: 2987963, mRNA, complete cds | 3.7E−259 |
| 3775 | M00042783C:F10 | MA171:E07 | 0.80366 | | | |
| 3776 | M00042702D:B02 | MA167:F07 | | AJ010446 | gi\|3954892\|emb\|AJ010446.1HSA010446 *Homo sapiens* mRNA for immunoglobulin kappa light chain, anti-RhD, therad 24 | 2.8E−154 |
| 3777 | M00042785B:F11 | MA171:H07 | | AF254415 | gi\|13897565\|gb\|AF254415.1AF254415 *Homo sapiens* gastrointestinal secretory protein GISP mRNA, complete cds | 3.9E−209 |

TABLE 32-continued

| SEQ ID NO | Clone ID | MAClone ID | Mask Prcnt | GBHit | GBDescription | GBScore |
|---|---|---|---|---|---|---|
| 3778 | M00056566C:C03 | MA174:A07 | | NM_031901 | gi|16950594|ref|NM_031901.2 *Homo sapiens* mitochondrial ribosomal protein S21 (MRPS21), transcript variant 1, nuclear gene encoding | 1.4E−255 |
| 3779 | M00056567B:A09 | MA174:C07 | | BC000396 | gi|12653254|gb|BC000396.1BC000396 *Homo sapiens*, ubiquitin-conjugating enzyme E2N (homologous to yeast UBC13), clone MGC: 8489 IMAGE: | 1E−293 |
| 3780 | M00056569B:D09 | MA174:G07 | | U61267 | gi|1418285|gb|U61267.1HSU61267 *Homo sapiens* putative splice factor transformer2-beta mRNA, complete cds | 4.4E−243 |
| 3781 | M00056571D:E05 | MA174:H07 | | BC017696 | gi|17389285|gb|BC017696.1BC017696 *Homo sapiens*, Similar to RIKEN cDNA 2410075D05 gene, clone MGC: 21057 IMAGE: 4393374, mRNA, complet | 6.6E−239 |
| 3782 | RG:376801:10009:C01 | MA158:C01 | | AB017642 | gi|4519628|dbj|AB017642.1AB017642 *Homo sapiens* mRNA for oxidative-stress responsive 1, complete cds | 8.9E−282 |
| 3783 | RG:365436:10009:B07 | MA158:B07 | | AK022055 | gi|10433374|dbj|AK022055.1AK022055 *Homo sapiens* cDNA FLJ11993 fis, clone HEMBB1001429, highly similar to *Homo sapiens* leucine amino | 1.1E−290 |
| 3784 | RG:416839:10009:D07 | MA158:D07 | | AK026432 | gi|10439295|dbj|AK026432.1AK026432 *Homo sapiens* cDNA: FLJ22779 fis, clone KAIA1741 | 0 |
| 3785 | RG:784224:10011:E07 | MA160:E07 | | L03840 | gi|182570|gb|L03840.1HUMFGFR4X Human fibroblast growth factor receptor 4 (FGFR4) mRNA, complete cds | 7.3E−258 |
| 3786 | RG:796852:10011:G07 | MA160:G07 | | AF087909 | gi|10121889|gb|AF087909.1AF087909 *Homo sapiens* NIMA-related kinase 6 (NEK6) mRNA, complete cds | 4.4E−271 |
| 3787 | M00043412A:F04 | MA184:E01 | | NM_000993 | gi|15812219|ref|NM_000993.2 *Homo sapiens* ribosomal protein L31 (RPL31), mRNA | 8.3E−158 |
| 3788 | M00057273B:H10 | MA182:H01 | | AB042820 | gi|11041627|dbj|AB042820.1AB042820 *Homo sapiens* RPL6 gene for ribosomal protein L6, complete cds | 5.6E−41 |
| 3789 | M00054506C:B10 | MA184:B07 | | NM_001012 | gi|4506742|ref|NM_001012.1 *Homo sapiens* ribosomal protein S8 (RPS8), mRNA | 2.6E−185 |
| 3790 | M00054507D:G03 | MA184:F07 | | U19765 | gi|790570|gb|U19765.1HSU19765 Human nucleic acid binding protein gene, complete cds | 1.5E−221 |
| 3791 | M00054935B:B03 | MA198:E01 | 0.06563 | NM_001644 | gi|5921993|ref|NM_001644.2 *Homo sapiens* apolipoprotein B mRNA editing enzyme, catalytic polypeptide 1 (APOBEC1), transcript variant | 1.2E−128 |
| 3792 | M00054935D:C11 | MA198:H01 | | NM_002026 | gi|16933541|ref|NM_002026.1 *Homo sapiens* fibronectin 1 (FN1), transcript variant 1, mRNA | 1.1E−190 |
| 3793 | M00054976A:E09 | MA198:D07 | | BC017189 | gi|16877928|gb|BC017189.1BC017189 *Homo sapiens*, myo-inositol 1-phosphate synthase A1, clone MGC: 726 IMAGE: 3140452, mRNA, complete c | 2.7E−188 |
| 3794 | M00055788B:F08 | MA170:C07 | | V00662 | gi|13003|emb|V00662.1MIHSXX *H. sapiens* mitochondrial genome | 1.3E−165 |
| 3795 | M00055791A:E10 | MA170:G07 | | X01117 | gi|57149|emb|X01117.1RNRRNA06 Rat 18S rRNA sequence | 7E−92 |
| 3796 | M00055224C:H11 | MA196:E07 | | BC008952 | gi|14286301|gb|BC008952.1BC008952 *Homo sapiens*, lactate dehydrogenase B, clone MGC: 3600 IMAGE: 3028947, mRNA, complete cds | 5E−171 |
| 3797 | M00055932A:C02 | MA179:B01 | | BC019362 | gi|17939458|gb|BC019362.1BC019362 *Homo sapiens*, guanine nucleotide binding protein (G protein), beta polypeptide 2-like 1, clone MG | 2.1E−226 |
| 3798 | M00056908A:F12 | MA177:C01 | 0.86486 | | | |
| 3799 | M00055935D:B06 | MA179:D01 | | D17041 | gi|598766|dbj|D17041.1HUMD3F06M5 Human HepG2 partial cDNA, clone hmd3f06m5 | 3.3E−182 |
| 3800 | M00056908D:D08 | MA177:E01 | | AK026649 | gi|10439547|dbj|AK026649.1AK026649 *Homo sapiens* cDNA: FLJ22996 fis, clone KAT11938 | 2.3E−154 |

TABLE 32-continued

| SEQ ID NO | Clone ID | MAClone ID | Mask Prcnt | GBHit | GBDescription | GBScore |
|---|---|---|---|---|---|---|
| 3801 | M00055942B:F08 | MA179:F01 | | X98311 | gi\|1524059\|emb\|X98311.1HSCGM2ANT *H. sapiens* mRNA for carcinoembryonic antigen family member 2, CGM2 | 5.9E−196 |
| 3802 | M00056910A:B07 | MA177:G01 | | BC009599 | gi\|16307042\|gb\|BC009599.1BC009599 *Homo sapiens*, clone MGC: 14690 IMAGE: 4134557, mRNA, complete cds | 8.3E−254 |
| 3803 | M00056952B:C08 | MA177:H07 | | Z85181 | gi\|1834892\|emb\|Z85181.1HSZ85181 *H. sapiens* Ig lambda light chain variable region gene (6-09OIIA61) rearranged; Ig-Light-Lambda; VLam | 8E−186 |
| 3804 | M00054728C:E03 | MA188:A01 | | M34664 | gi\|184411\|gb\|M34664.1HUMHSP60A Human chaperonin (HSP60) mRNA, complete cds | 1.3E−283 |
| 3805 | M00054728D:E06 | MA188:B01 | | X16064 | gi\|37495\|emb\|X16064.1HSTUMP Human mRNA for translationally controlled tumor protein | 1E−300 |
| 3806 | M00054731C:H01 | MA188:H01 | | X73502 | gi\|406853\|emb\|X73502.1HSENCY20 *H. Sapiens* mRNA for cytokeratin 20 | 1.9E−267 |
| 3807 | M00054778B:A12 | MA188:D07 | | AJ276249 | gi\|7362984\|emb\|AJ276249.1HSA276249 *Homo sapiens* partial mRNA, clone cl-10e16 | 2E−91 |
| 3808 | M00054778C:D08 | MA188:F07 | | NM_002137 | gi\|14043073\|ref\|NM_002137.2 *Homo sapiens* heterogeneous nuclear ribonucleoprotein A2/B1 (HNRPA2B1), transcript variant A2, mRNA | 1.8E−34 |
| 3809 | M00054780A:G06 | MA188:H07 | | BC000035 | gi\|12652584\|gb\|BC000035.1BC000035 *Homo sapiens*, CGI-89 protein, clone MGC: 845 IMAGE: 3506601, mRNA, complete cds | 3.6E−287 |
| 3810 | M00042899D:D02 | MA168:A01 | | Y00339 | gi\|29586\|emb\|Y0039.1HSCA2 Human mRNA for carbonic anhydrase II (EC 4.2.1.1) | 1.5E−233 |
| 3811 | M00042831B:G10 | MA172:C01 | | AK024740 | gi\|10437104\|dbj\|AK024740.1AK024740 *Homo sapiens* cDNA: FLJ21087 fis, clone CAS03323 | 6.2E−264 |
| 3812 | M00042833A:G07 | MA172:D01 | | AF047470 | gi\|2906145\|gb\|AF047470.1AF047470 *Homo sapiens* malate dehydrogenase precursor (MDH) mRNA, nuclear gene encoding mitochondrial protei | 3E−166 |
| 3813 | M00042906D:F05 | MA168:E01 | | L31792 | gi\|471076\|gb\|L31792.1HUMCGM2A *Homo sapiens* carcinoembryonic antigen (CGM2) mRNA, complete cds | 1.1E−200 |
| 3814 | M00042910C:A02 | MA168:G01 | | AF113700 | gi\|6855634\|gb\|AF113700.1AF113700 *Homo sapiens* clone FLB9737 | 7.6E−245 |
| 3815 | M00042838C:D06 | MA172:H01 | | AK026558 | gi\|10439440\|dbj\|AK026558.1AK026558 *Homo sapiens* cDNA: FLJ22905 fis, clone KAT05654, highly similar to HUMRPL18A *Homo sapiens* riboso | 1.7E−214 |
| 3816 | M00042867B:F03 | MA172:A07 | 0.30983 | D87666 | gi\|1620016\|dbj\|D87666.1D87666 Human heart mRNA for heat shock protein 90, partial cds | 1.3E−101 |
| 3817 | M00055439B:G05 | MA168:B07 | | AY029066 | gi\|14017398\|gb\|AY029066.1 *Homo sapiens* Humanin (HN1) mRNA, complete cds | 9.6E−263 |
| 3818 | M00055442D:E12 | MA168:F07 | | BC005354 | gi\|13529169\|gb\|BC005354.1BC005354 *Homo sapiens*, ribosomal protein, large P2, clone MGC: 12453 IMAGE: 4052568, mRNA, complete cds | 6.6E−239 |
| 3819 | M00056711D:A02 | MA175:B01 | | Z11566 | gi\|1066270\|emb\|Z11566.1HSPR22MR *H. sapiens* mRNA for Pr22 protein | 6.7E−133 |
| 3820 | M00056771C:A12 | MA175:A07 | | X02152 | gi\|34312\|emb\|X02152.1HSLDHAR Human mRNA for lactate dehydrogenase-A (LDH-A, EC 1.1.1.27) | 6E−130 |
| 3821 | M00056772D:G07 | MA175:C07 | | NM_001016 | gi\|14277699\|ref\|NM_001016.2 *Homo sapiens* ribosomal protein S12 (RPS12), mRNA | 1.2E−218 |
| 3822 | M00056782D:E04 | MA175:F07 | | AF346968 | gi\|13272626\|gb\|AF346968.1AF346968 *Homo sapiens* mitochondrion, complete genome | 3.6E−172 |
| 3823 | M00056785D:G01 | MA175:G07 | | NM_001019 | gi\|14165468\|ref\|NM_001019.2 *Homo sapiens* ribosomal protein S15a (RPS15A), mRNA | 1.5E−230 |
| 3824 | M00056788C:A01 | MA175:H07 | | AY029066 | gi\|14017398\|gb\|AY029066.1 *Homo sapiens* Humanin (HN1) mRNA, complete cds | 3.5E−287 |

TABLE 32-continued

| SEQ ID NO | Clone ID | MAClone ID | Mask Prcnt | GBHit | GBDescription | GBScore |
|---|---|---|---|---|---|---|
| 3825 | RG:1663880:10014:F07 | MA163:F07 | | BC019315 | gi\|17939511\|gb\|BC019315.1BC019315 *Homo sapiens*, N-acetylneuraminic acid phosphate synthase; sialic acid synthase, clone MGC: 4339 IM | 1E−300 |
| 3826 | M00043310B:D08 | MA183:C01 | | NM_000969 | gi\|14591908\|ref\|NM_000969.2 *Homo sapiens* ribosomal protein L5 (RPL5), mRNA | 1.5E−261 |
| 3827 | M00054538C:G03 | MA185:C01 | | BC000734 | gi\|12653884\|gb\|BC000734.1BC000734 *Homo sapiens*, eukaryotic translation initiation factor 3, subunit 6 (48 kD), clone MGC: 2060 IMAGE: | 4E−234 |
| 3828 | M00043315C:G05 | MA183:H01 | | AK023362 | gi\|10435266\|dbj\|AK023362.1AK023362 *Homo sapiens* cDNA FLJ13300 fis, clone OVARC1001342, highly similar to 40S RIBOSOMAL PROTEIN S8 | 2.7E−241 |
| 3829 | M00055397B:E08 | MA199:B01 | | X06747 | gi\|36101\|emb\|X06747.1HSRNPA1 Human hnRNP core protein A1 | 9.7E−132 |
| 3830 | M00056624B:H11 | MA186:C01 | | X56597 | gi\|31394\|emb\|X56597.1HSFIB Human humFib mRNA for fibrillarin | 7.7E−192 |
| 3831 | M00055423C:C03 | MA199:E07 | | L01124 | gi\|307390\|gb\|L01124.1HUMRPS13A Human ribosomal protein S13 (RPS13) mRNA, complete cds | 9.1E−154 |
| 3832 | M00056668D:C06 | MA186:F07 | | BC013231 | gi\|15301504\|gb\|BC013231.1BC013231 *Homo sapiens*, clone IMAGE: 3462987, mRNA | 9.8E−263 |
| 3833 | M00056669B:A10 | MA186:G07 | | NM_001025 | gi\|14790142\|ref\|NM_001025.2 *Homo sapiens* ribosomal protein S23 (RPS23), mRNA | 3.7E−290 |
| 3834 | M00055424A:D01 | MA199:G07 | | BC002362 | gi\|12803116\|gb\|BC002362.1BC002362 *Homo sapiens*, lactate dehydrogenase B, clone MGC: 8627 IMAGE: 2961445, mRNA, complete cds | 6.4E−183 |
| 3835 | M00056669B:E07 | MA186:H07 | | NM_002295 | gi\|9845501\|ref\|NM_002295.2 *Homo sapiens* laminin receptor 1 (67 kD, ribosomal protein SA) (LAMR1), mRNA | 9.1E−232 |
| 3836 | M00055424D:F01 | MA199:H07 | | NM_001012 | gi\|4506742\|ref\|NM_001012.1 *Homo sapiens* ribosomal protein S8 (RPS8), mRNA | 4.4E−190 |
| 3837 | M00056243A:H07 | MA181:C02 | 0.86405 | | | |
| 3838 | M00056243C:G10 | MA181:D02 | 0.46512 | | | |
| 3839 | M00055528D:H03 | MA169:F02 | 0.6783 | | | |
| 3840 | M00055607B:A11 | MA169:B08 | | AF161415 | gi\|6841243\|gb\|AF161415.1AF161415 *Homo sapiens* HSPC297 mRNA, partial cds | 3.5E−253 |
| 3841 | M00055363C:E02 | MA197:A08 | 0.62737 | | | |
| 3842 | M00055373D:H02 | MA197:F08 | | BC013016 | gi\|15278200\|gb\|BC013016.1BC013016 *Homo sapiens*, Similar to ribosomal protein L19, clone MGC: 4526 IMAGE: 3010178, mRNA, complete cds | 3.3E−125 |
| 3843 | M00055374D:E01 | MA197:H08 | | NM_000979 | gi\|15431298\|ref\|NM_000979.2 *Homo sapiens* ribosomal protein L18 (RPL18), mRNA | 1.5E−261 |
| 3844 | M00056401D:D09 | MA173:A02 | | BC008492 | gi\|14250147\|gb\|BC008492.1BC008492 *Homo sapiens*, ribosomal protein L3, clone MGC: 14821 IMAGE: 4251511, mRNA, complete cds | 1.6E−105 |
| 3845 | M00056139D:A10 | MA180:B02 | | X16356 | gi\|37203\|emb\|X16356.1HSTM3CEA Human mRNA for transmembrane carcinoembryonic antigen BGPC (part.) (formerly TM3-CEA) | 3.9E−237 |
| 3846 | M00056140A:E11 | MA180:D02 | | U96628 | gi\|2343084\|gb\|U96628.1HSU96628 *Homo sapiens* nuclear antigen H731-like protein mRNA, complete cds | 2.4E−182 |
| 3847 | M00056142D:A08 | MA180:E02 | | BC015958 | gi\|16358989\|gb\|BC015958.1BC015958 *Homo sapiens*, clone MGC: 15290 IMAGE: 3940309, mRNA, complete cds | 4.2E−268 |
| 3848 | M00056412D:A09 | MA173:F02 | 0.85039 | | | |
| 3849 | M00056142D:H11 | MA180:F02 | | AK025078 | gi\|10437520\|dbj\|AK025078.1AK025078 *Homo sapiens* cDNA: FLJ21425 fis, clone COL04162 | 3.8E−120 |
| 3850 | M00056414C:F03 | MA173:G02 | | M29548 | gi\|181966\|gb\|M29548.1HUMEF1AB Human elongation factor 1-alpha (EF1A) mRNA, partial cds | 1.7E−114 |

TABLE 32-continued

| SEQ ID NO | Clone ID | MAClone ID | Mask Prcnt | GBHit | GBDescription | GBScore |
|---|---|---|---|---|---|---|
| 3851 | M00056196A:H09 | MA180:B08 | | D84239 | gi\|1944351\|dbj\|D84239.1D84239 *Homo sapiens* mRNA for IgG Fc binding protein, complete cds | 2E−251 |
| 3852 | M00056200A:E11 | MA180:D08 | | U14528 | gi\|549987\|gb\|U14528.1HSU14528 Human sulfate transporter (DTD) mRNA, complete cds | 4.3E−299 |
| 3853 | M00056488C:G01 | MA173:E08 | | L08048 | gi\|184250\|gb\|L08048.1HUMHMG1C Human non-histone chromosomal protein (HMG-1) retropseudogene | 3.3E−281 |
| 3854 | M00056200B:B01 | MA180:E08 | | D84239 | gi\|1944351\|dbj\|D84239.1D84239 *Homo sapiens* mRNA for IgG Fc binding protein, complete cds | 1.5E−233 |
| 3855 | M00056203B:G08 | MA180:F08 | 0.89391 | | | |
| 3856 | M00056493A:F09 | MA173:H08 | | X14831 | gi\|37199\|emb\|X14831.1HSTM2CEA Human mRNA for transmembrane carcinoembryonic antigen BGPb (formerly TM2-CEA) | 4.2E−115 |
| 3857 | M00054640D:D12 | MA187:B02 | 0.89884 | | | |
| 3858 | M00054643B:F04 | MA187:D02 | 0.66848 | | | |
| 3859 | M00054643C:D08 | MA187:E02 | | BC000491 | gi\|12653440\|gb\|BC000491.1BC000491 *Homo sapiens*, proliferating cell nuclear antigen, clone MGC: 8367 IMAGE: 2820036, mRNA, complete cd | 1.6E−236 |
| 3860 | M00054854D:B06 | MA189:F02 | | M16660 | gi\|184420\|gb\|M16660.1HUMHSP90 Human 90-kDa heat-shock protein gene, cDNA, complete cds | 2.4E−263 |
| 3861 | M00054644B:F02 | MA187:G02 | | BC017414 | gi\|16924273\|gb\|BC017414.1BC017414 *Homo sapiens*, Similar to signal recognition particle 9 kD, clone IMAGE: 4655251, mRNA, partial cds | 1.2E−246 |
| 3862 | M00054857A:E08 | MA189:G02 | | BC016753 | gi\|16876954\|gb\|BC016753.1BC016753 *Homo sapiens*, clone MGC: 1138 IMAGE: 2987963, mRNA, complete cds | 8.6E−229 |
| 3863 | M00054681D:G03 | MA187:B08 | | BC019360 | gi\|17939583\|gb\|BC019360.1BC019360 *Homo sapiens*, clone IMAGE: 4025624, mRNA | 1E−300 |
| 3864 | M00054682D:F11 | MA187:D08 | 0.13542 | AF116637 | gi\|7959775\|gb\|AF116637.1AF116637 *Homo sapiens* PRO1489 mRNA, complete cds | 3.2E−210 |
| 3865 | M00054684B:C07 | MA187:F08 | | BC001781 | gi\|12804704\|gb\|BC001781.1BC001781 *Homo sapiens*, ribosomal protein L44, clone MGC: 2064 IMAGE: 3353669, mRNA, complete cds | 8.6E−176 |
| 3866 | M00057191B:E11 | MA193:D02 | | AK026528 | gi\|10439405\|dbj\|AK026528.1AK026528 *Homo sapiens* cDNA: FLJ22875 fis, clone KAT02879 | 4.6E−274 |
| 3867 | M00057194B:G12 | MA193:G02 | | AF228422 | gi\|12656020\|gb\|AF228422.1AF228422 *Homo sapiens* normal mucosa of esophagus specific 1 (NMES1) mRNA, complete cds | 1.9E−117 |
| 3868 | M00057222D:G09 | MA193:B08 | | D49400 | gi\|1395161\|dbj\|D49400.1HUMVATPASE *Homo sapiens* mRNA for vacuolar ATPase, complete cds | 3.9E−262 |
| 3869 | M00042531B:H03 | MA167:A02 | | M15042 | gi\|180198\|gb\|M15042.1HUMCEA Human carcinoembryonic antigen mRNA | 6.3E−211 |
| 3870 | M00042440C:G04 | MA171:A02 | 0.89441 | | | |
| 3871 | M00042533C:D02 | MA167:C02 | | X56999 | gi\|37568\|emb\|X56999.1HSUBA52P Human UbA52 placental mRNA for ubiquitin-52 amino acid fusion protein | 3.7E−29 |
| 3872 | M00042536D:H05 | MA167:E02 | | AF146019 | gi\|10197599\|gb\|AF146019.1AF146019 *Homo sapiens* hepatocellular carcinoma antigen gene 520 mRNA, complete cds | 3E−26 |
| 3873 | M00042465B:E04 | MA171:E02 | | BC016732 | gi\|16876903\|gb\|BC016732.1BC016732 *Homo sapiens*, thymosin, beta 4, X chromosome, clone MGC: 24503 IMAGE: 4096207, mRNA, complete cds | 5.7E−202 |
| 3874 | M00042537D:F10 | MA167:F02 | | BC000889 | gi\|12654142\|gb\|BC000889.1BC000889 *Homo sapiens*, RNA polymerase I 16 kDa subunit, clone MGC: 4881 IMAGE: 3462906, mRNA, complete cds | 1.6E−236 |
| 3875 | M00042467B:B04 | MA171:F02 | | V00572 | gi\|35434\|emb\|V00572.1HSPGK1 Human mRNA encoding phosphoglycerate kinase | 1E−240 |
| 3876 | M00042538D:D12 | MA167:G02 | | X68195 | gi\|36165\|emb\|X68195.1HSRSPAC *H. sapiens* genomic DNA of ribosomal RNA intergenic spacer sequence | 6.6E−24 |

TABLE 32-continued

| SEQ ID NO | Clone ID | MAClone ID | Mask Prcnt | GBHit | GBDescription | GBScore |
|---|---|---|---|---|---|---|
| 3877 | M00042467B:B08 | MA171:G02 | | U11861 | gi\|515482\|gb\|U11861.1HSU11861 Human G10 homolog (edg-2) mRNA, complete cds | 1.7E−165 |
| 3878 | M00042711B:G09 | MA167:B08 | | AF130094 | gi\|11493492\|gb\|AF130094.1AF130094 Homo sapiens clone FLC0165 mRNA sequence | 3E−207 |
| 3879 | M00042790B:E12 | MA171:B08 | | AF039400 | gi\|4009457\|gb\|AF039400.1AF039400 Homo sapiens calcium-dependent chloride channel-1 (hCLCA1) mRNA, complete cds | 5.9E−261 |
| 3880 | M00042791A:C10 | MA171:C08 | | NM_000147 | gi\|4503802\|ref\|NM_000147.1 Homo sapiens fucosidase, alpha-L-1, tissue (FUCA1), mRNA | 1.3E−252 |
| 3881 | M00042711C:H05 | MA167:D08 | | X16354 | gi\|37197\|emb\|X16354.1HSTM1CEA Human mRNA for transmembrane carcinoembryonic antigen BGPa (formerly TM1-CEA) | 2.7E−163 |
| 3882 | M00042801D:B02 | MA171:H08 | | BC002348 | gi\|12803088\|gb\|BC002348.1BC002348 Homo sapiens, nuclear transport factor 2 (placental protein 15), clone MGC: 8327 IMAGE: 2819267, mR | 4.9E−196 |
| 3883 | M00042801D:B02 | MA171:H08 | | BC002348 | gi\|12803088\|gb\|BC002348.1BC002348 Homo sapiens, nuclear transport factor 2 (placental protein 15), clone MGC: 8327 IMAGE: 2819267, mR | 4.9E−196 |
| 3884 | M00056532A:D09 | MA174:C02 | 0.78082 | | | |
| 3885 | M00056533D:H04 | MA174:E02 | | AK000070 | gi\|7019918\|dbj\|AK000070.1AK000070 Homo sapiens cDNA FLJ20063 fis, clone COL01524 | 3.6E−287 |
| 3886 | M00056575B:C04 | MA174:B08 | | AK000113 | gi\|7019989\|dbj\|AK000113.1AK000113 Homo sapiens cDNA FLJ20106 fis, clone COL04830 | 2.4E−263 |
| 3887 | M00056578C:A09 | MA174:C08 | | NM_000988 | gi\|17017972\|ref\|NM_000988.2 Homo sapiens ribosomal protein L27 (RPL27), mRNA | 2.1E−198 |
| 3888 | RG:1862072:20001:D08 | MA139:D08 | | X61633 | gi\|37957\|emb\|X61633.1HSWIGEEX4 H. sapiens Wilms tumor gene 1, exon 4 | 9.2E−25 |
| 3889 | RG:1862465:20001:F08 | MA139:F08 | 0.81221 | | | |
| 3890 | RG:347381:10009:A02 | MA158:A02 | | U38846 | gi\|1200183\|gb\|U38846.1HSU38846 Human stimulator of TAR RNA binding (SRB) mRNA, complete cds | 0 |
| 3891 | RG:417093:10009:D08 | MA158:D08 | 0.08361 | M17885 | gi\|190231\|gb\|M17885.1HUMPPARP0 Human acidic ribosomal phosphoprotein P0 mRNA, complete cds | 4.4E−216 |
| 3892 | M00043413B:C04 | MA184:A02 | | AK027437 | gi\|14042109\|dbj\|AK027437.1AK027437 Homo sapiens cDNA FLJ14531 fis, clone NT2RM2000371, weakly similar to POLYRIBONUCLEOTIDE NUCLEOT | 5.2E−174 |
| 3893 | M00043502D:C12 | MA184:F02 | | BC000820 | gi\|12654032\|gb\|BC000820.1BC000820 Homo sapiens, menage a trois 1 (CAK assembly factor), clone MGC: 5154 IMAGE: 3453943, mRNA, complet | 5.2E−252 |
| 3894 | M00057341B:B11 | MA182:E08 | | BC001955 | gi\|12805002\|gb\|BC001955.1BC001955 Homo sapiens, ribosomal protein S10, clone MGC: 4389 IMAGE: 2905318, mRNA, complete cds | 1.1E−243 |
| 3895 | M00054512A:F11 | MA184:G08 | 0.19488 | | | |
| 3896 | M00042353A:D05 | MA182:H08 | | BC016352 | gi\|16741002\|gb\|BC016352.1BC016352 Homo sapiens, small acidic protein, clone MGC: 24468 IMAGE: 4082845, mRNA, complete cds | 2E−123 |
| 3897 | M00054937B:D09 | MA198:B02 | | S79979 | gi\|1839333\|gb\|S79979.1S79979 ribosomal protein L37 [human, HeLa cells, Genomic/mRNA, 754 nt] | 2.8E−75 |
| 3898 | M00055797C:H09 | MA170:D08 | | BC009699 | gi\|16307220\|gb\|BC009699.1BC009699 Homo sapiens, Similar to RNA helicase-related protein, clone MGC: 9246 IMAGE: 3892441, mRNA, comple | 8.2E−226 |
| 3899 | M00055799B:C01 | MA170:E08 | | X01117 | gi\|57149\|emb\|X01117.1RNRRNA06 Rat 18S rRNA sequence | 1.5E−51 |
| 3900 | M00055194C:G12 | MA196:D02 | | BC008062 | gi\|14165518\|gb\|BC008062.1BC008062 Homo sapiens, basic transcription factor 3, clone MGC: 2209 IMAGE: 2966788, mRNA, complete cds | 7.7E−27 |
| 3901 | M00055233B:D08 | MA196:B08 | 0.55474 | | | |
| 3902 | M00055966C:D06 | MA179:H02 | | | | |

TABLE 32-continued

| SEQ ID NO | Clone ID | MAClone ID | Mask Prcnt | GBHit | GBDescription | GBScore |
|---|---|---|---|---|---|---|
| 3903 | M00056024B:B06 | MA179:D08 | | BC011949 | gi\|15080385\|gb\|BC011949.1BC011949 *Homo sapiens*, Similar to carbonic anhydrase II, clone MGC: 9006 IMAGE: 3863603, mRNA, complete cds | 6E−261 |
| 3904 | M00056024C:G04 | MA179:E08 | | | | |
| 3905 | M00054737D:F10 | MA188:D02 | | BC018828 | gi\|17402971\|gb\|BC018828.1BC018828 *Homo sapiens*, clone IMAGE: 3343539, mRNA | 3.5E−284 |
| 3906 | M00054780D:C09 | MA188:A08 | | BC007967 | gi\|14044092\|gb\|BC007967.1BC007967 *Homo sapiens*, clone MGC: 14460 IMAGE: 4304670, mRNA, complete cds | 2.2E−151 |
| 3907 | M00054787A:E09 | MA188:D08 | | NM_006013 | gi\|15718685\|ref\|NM_006013.2 *Homo sapiens* ribosomal protein L10 (RPL10), mRNA | 8E−279 |
| 3908 | M00054806B:E11 | MA188:E08 | | AK026650 | gi\|10439548\|dbj\|AK026650.1AK026650 *Homo sapiens* cDNA: FLJ22997 fis, clone KAT11962, highly similar to HSEF1AC Human mRNA for elonga | 1.3E−252 |
| 3909 | M00042913B:C11 | MA168:B02 | | NM_000999 | gi\|16306562\|ref\|NM_000999.2 *Homo sapiens* ribosomal protein L38 (RPL38), mRNA | 2.4E−182 |
| 3910 | M00042915B:B10 | MA168:D02 | | AK058013 | gi\|16554011\|dbj\|AK058013.1AK058013 *Homo sapiens* cDNA FLJ25284 fis, clone STM06787, highly similar to 15-HYDROXYPROSTAGLANDIN DEHYDR | 2.2E−201 |
| 3911 | M00054792C:E12 | MA168:E02 | | D14530 | gi\|414348\|dbj\|D14530.1HUMRSPT Human homolog of yeast ribosomal protein S28, complete cds | 4.1E−268 |
| 3912 | M00042842A:C01 | MA172:G02 | 0.66829 | | | |
| 3913 | M00055450A:C09 | MA168:H08 | 0.8 | | | |
| 3914 | M00056804C:D01 | MA175:H08 | | AF126743 | gi\|5052332\|gb\|AF126743.1AF126743 *Homo sapiens* DNAJ domain-containing Protein MCJ (MCJ) mRNA, complete cds | 3.1E−278 |
| 3915 | RG:1647954:10014:D08 | MA163:D08 | | NM_001261 | gi\|17017983\|ref\|NM_001261.2 *Homo sapiens* cyclin-dependent kinase 9 (CDC2-related kinase) (CDK9), mRNA | 1.9E−273 |
| 3916 | RG: 1664311:10014:F08 | MA163:F08 | | X02761 | gi\|31396\|emb\|X02761.1HSFIB1 Human mRNA for fibronectin (FN precursor) | 0 |
| 3917 | RG: 1671377:10014:G08 | MA163:G08 | | BC013078 | gi\|15341811\|gb\|BC013078.1BC013078 *Homo sapiens*, clone MGC: 17534 IMAGE: 3459415, mRNA, complete cds | 2.8E−297 |
| 3918 | M00043316B:F10 | MA183:C02 | | X16064 | gi\|37495\|emb\|X16064.1HSTUMP Human mRNA for translationally controlled tumor protein | 2.7E−269 |
| 3919 | M00054545B:A03 | MA185:D02 | | AF151048 | gi\|7106817\|gb\|AF151048.1AF151048 *Homo sapiens* HSPC214 mRNA, complete cds | 4.6E−271 |
| 3920 | M00054545B:B09 | MA185:E02 | 0.07415 | X07979 | gi\|31441\|emb\|X07979.1HSFNRB Human mRNA for integrin beta 1 subunit | 1.2E−126 |
| 3921 | M00054575A:B09 | MA185:D08 | | X16064 | gi\|37495\|emb\|X16064.1HSTUMP Human mRNA for translationally controlled tumor protein | 3.2E−278 |
| 3922 | M00043374B:H05 | MA183:F08 | 0.11186 | NM_053275 | gi\|16933545\|ref\|NM_053275.1 *Homo sapiens* ribosomal protein, large, P0 (RPLP0), transcript variant 2, mRNA | 3E−136 |
| 3923 | M00056641A:G11 | MA186:F02 | | BC003352 | gi\|13097158\|gb\|BC003352.1BC003352 *Homo sapiens*, tumor protein, translationally-controlled 1, clone MGC: 5308 IMAGE: 2899964, mRNA, co | 3.6E−284 |
| 3924 | M00056642A:D08 | MA186:H02 | 0.78693 | | | |
| 3925 | M00055403B:B11 | MA199:H02 | | NM_001021 | gi\|14591913\|ref\|NM_001021.2 *Homo sapiens* ribosomal protein S17 (RPS17), mRNA | 5.8E−180 |
| 3926 | M00056676B:C11 | MA186:H08 | | AF346968 | gi\|13272626\|gb\|AF346968.1AF346968 *Homo sapiens* mitochondrion, complete genome | 4.6E−165 |
| 3927 | M00055530D:B02 | MA169:B03 | | NM_001012 | gi\|4506742\|ref\|NM_001012.1 *Homo sapiens* ribosomal protein S8 (RPS8), mRNA | 1.5E−261 |
| 3928 | M00056253A:D06 | MA181:C03 | | BC014166 | gi\|15559610\|gb\|BC014166.1BC014166 *Homo sapiens*, clone IMAGE: 4549553, mRNA | 1.2E−274 |

TABLE 32-continued

| SEQ ID NO | Clone ID | MAClone ID | Mask Prcnt | GBHit | GBDescription | GBScore |
|---|---|---|---|---|---|---|
| 3929 | M00056253B:B06 | MA181:D03 | | BC000053 | gi|12652614|gb|BC000053.1BC000053 *Homo sapiens*, LPS-induced TNF-alpha factor, clone IMAGE: 3506981, mRNA | 1.7E−270 |
| 3930 | M00055642D:F09 | MA169:D09 | | AF203815 | gi|6979641|gb|AF203815.1AF203815 *Homo sapiens* alpha gene sequence | 2.2E−257 |
| 3931 | M00055643A:E09 | MA169:E09 | | J03037 | gi|179771|gb|J03037.1HUMCAIIA Human carbonic anhydrase II mRNA, complete cds | 3E−247 |
| 3932 | M00055643D:E02 | MA169:F09 | | M10050 | gi|182355|gb|M10050.1HUMFABPL Human liver fatty acid binding protein (FABP) mRNA, complete cds | 2.1E−251 |
| 3933 | M00055376D:D08 | MA197:B09 | | D38112 | gi|644480|dbj|D38112.1HUMMTA *Homo sapiens* mitochondrial DNA, complete sequence | 8.5E−111 |
| 3934 | M00056415C:D02 | MA173:B03 | 0.67751 | | | |
| 3935 | M00056146D:F05 | MA180:B03 | 0.61693 | | | |
| 3936 | M00056417A:F02 | MA173:C03 | | Z85099 | gi|1834810|emb|Z85099.1HSZ85099 *H. sapiens* Ig lambda light chain variable region gene (3-01OIIA11) rearranged; Ig-Light-Lambda; VLam | 2.7E−31 |
| 3937 | M00056148A:B07 | MA180:C03 | | AK026170 | gi|10438933|dbj|AK026170.1AK026170 *Homo sapiens* cDNA: FLJ22517 fis, clone HRC12186 | 4.8E−134 |
| 3938 | M00056420C:E07 | MA173:D03 | | BC010735 | gi|14789596|gb|BC010735.1BC010735 *Homo sapiens*, Similar to eukaryotic translation elongation factor 1 alpha 1, clone MGC: 10096 IMAG | 3.7E−262 |
| 3939 | M00056150A:E04 | MA180:D03 | 0.82941 | | | |
| 3940 | M00056421C:H11 | MA173:F03 | | X60489 | gi|31099|emb|X60489.1HSEF1B Human mRNA for elongation factor-1-beta | 3.5E−228 |
| 3941 | M00056150C:A10 | MA180:F03 | | AL360191 | gi|8919392|emb|AL360191.1HST000237 *Homo sapiens* mRNA full length insert cDNA clone EUROIMAGE 781354 | 1.1E−237 |
| 3942 | M00056421D:H05 | MA173:G03 | | BC017338 | gi|16878283|gb|BC017338.1BC017338 *Homo sapiens*, fucosidase, alpha-L-1, tissue, clone MGC: 29579 IMAGE: 4871788, mRNA, complete cds | 1.1E−159 |
| 3943 | M00056150C:C04 | MA180:G03 | | AJ276249 | gi|7362984|emb|AJ276249.1HSA276249 *Homo sapiens* partial mRNA, clone cl-10e16 | 1.3E−98 |
| 3944 | M00056422B:D11 | MA173:H03 | | BC001289 | gi|12654890|gb|BC001289.1BC001289 *Homo sapiens*, Sjogren syndrome antigen B (autoantigen La), clone MGC: 5194 IMAGE: 3454454, mRNA, co | 1.9E−120 |
| 3945 | M00056151C:A12 | MA180:H03 | | X59706 | gi|34204|emb|X59706.1HSLA1L1IG *H. sapiens* rearranged Humigla1L1 gene encoding IgG light chain | 1.5E−227 |
| 3946 | M00056493C:E06 | MA173:A09 | | AF153608 | gi|5231140|gb|AF153608.1AF153608 *Homo sapiens* sin3 associated polypeptide (SAP18) mRNA, complete cds | 1.3E−280 |
| 3947 | M00056205D:E03 | MA180:A09 | 0.78241 | | | |
| 3948 | M00056495A:G10 | MA173:B09 | | M63573 | gi|337998|gb|M63573.1HUMSCYLP Human secreted cyclophilin-like protein (SCYLP) mRNA, complete cds | 4.5E−100 |
| 3949 | M00056206D:B10 | MA180:E09 | | AF001893 | gi|2529723|gb|AF001893.1BETA2 Human MEN1 region clone epsilon/beta mRNA, 3' fragment | 1.1E−35 |
| 3950 | M00056501D:C08 | MA173:H09 | | Y11339 | gi|7576275|emb|Y11339.2HSY11339 *Homo sapiens* mRNA for GalNAc alpha-2, 6-sialyltransferase I, long form | 1.9E−220 |
| 3951 | M00056209D:H10 | MA180:H09 | 0.08151 | J03037 | gi|179771|gb|J03037.1HUMCAIIA Human carbonic anhydrase II mRNA, complete cds | 1.6E−258 |
| 3952 | M00054645B:C12 | MA187:B03 | 0.18868 | BC008092 | gi|14198047|gb|BC008092.1BC008092 *Homo sapiens*, ribosomal protein, large, P0, clone MGC: 9343 IMAGE: 3458803, mRNA, complete cds | 7.3E−105 |
| 3953 | M00054646A:B10 | MA187:C03 | | BC007097 | gi|13937968|gb|BC007097.1BC007097 *Homo sapiens*, tissue inhibitor of metalloproteinase 1 (erythroid potentiating activity, collagena | 5.2E−146 |
| 3954 | M00054647D:E01 | MA187:G03 | | NM_001026 | gi|14916502|ref|NM_001026.2 *Homo sapiens* ribosomal protein S24 (RPS24), transcript variant 2, mRNA | 6.4E−111 |
| 3955 | M00057202C:G06 | MA193:E03 | | | | |

TABLE 32-continued

| SEQ ID NO | Clone ID | MAClone ID | Mask Prcnt | GBHit | GBDescription | GBScore |
|---|---|---|---|---|---|---|
| 3956 | M00057202D:C11 | MA193:F03 | | X71973 | gi\|311699\|emb\|X71973.1HSGPX4 *H. sapiens* GPx-4 mRNA for phospholipid hydroperoxide glutathione peroxidase | 1.3E−26 |
| 3957 | M00042549A:G12 | MA167:C03 | | AF153609 | gi\|5231142\|gb\|AF153609.1A1F153609 *Homo sapiens* serine/threonine protein kinase sgk mRNA, complete cds | 1.8E−120 |
| 3958 | M00042549D:F03 | MA167:D03 | | BC011025 | gi\|15029635\|gb\|BC011025.1BC011025 *Homo sapiens*, Similar to sorcin, clone MGC: 13597 IMAGE: 4281626, mRNA, complete cds | 6.8E−34 |
| 3959 | M00042551B:D12 | MA167:E03 | | NM_002295 | gi\|9845501\|ref\|NM_002295.2 *Homo sapiens* laminin receptor 1 (67 kD, ribosomal protein SA) (LAMR1), mRNA | 8.3E−226 |
| 3960 | M00042513A:D03 | MA171:E03 | | NM_001002 | gi\|16933547\|ref\|NM_001002.2 *Homo sapiens* ribosomal protein, large, P0 (RPLP0), transcript variant 1, mRNA | 2.5E−266 |
| 3961 | M00042513D:A12 | MA171:F03 | 0.53205 | | | |
| 3962 | M00042551D:D12 | MA167:H03 | | Z48514 | gi\|695600\|emb\|Z48514.1HSXGR4551 *H. sapiens* XG mRNA (clone R4(551)) | 2.8E−191 |
| 3963 | M00042717B:D05 | MA167:A09 | 0.47619 | X98311 | gi\|1524059\|emb\|X98311.1HSCGM2ANT *H. sapiens* mRNA for carcinoembryonic antigen family member 2, CGM2 | 1.1E−45 |
| 3964 | M00042719D:C09 | MA167:B09 | | L31792 | gi\|471076\|gb\|L31792.1HUMCGM2A *Homo sapiens* carcinoembryonic antigen (CGM2) mRNA, complete cds | 4.2E−144 |
| 3965 | M00042803C:F11 | MA171:C09 | | M31520 | gi\|337504\|gb\|M31520.1HUMRPS24A Human ribosomal protein S24 mRNA | 7.6E−120 |
| 3966 | M00042805D:D12 | MA171:E09 | | BC004324 | gi\|13279235\|gb\|BC004324.1BC004324 *Homo sapiens*, ribosomal protein S16, clone MGC: 10931 IMAGE: 3628799, mRNA, complete cds | 2.4E−263 |
| 3967 | M00042731A:G04 | MA167:F09 | | Z84867 | gi\|1834578\|emb\|Z84867.1HSZ84867 *H. sapiens* Ig lambda light chain variable region gene (14-09DPIA215) rearranged; Ig-Light-Lambda; VL | 5.8E−113 |
| 3968 | M00042806C:E09 | MA171:G09 | 0.12055 | U16738 | gi\|608516\|gb\|U16738.1HSU16738 *Homo sapiens* CAG-isl 7 mRNA, complete cds | 1.4E−165 |
| 3969 | M00042806D:F08 | MA171:H09 | | Y16241 | gi\|3378195\|emb\|Y16241.1HSY16241 *Homo sapiens* mRNA for nebulette | 3E−247 |
| 3970 | M00056537A:F05 | MA174:C03 | | NM_021130 | gi\|10863926\|ref\|NM_021130.1 *Homo sapiens* peptidylprolyl isomerase A (cyclophilin A) (PPIA), mRNA | 5.1E−249 |
| 3971 | M00056537D:A07 | MA174:D03 | | BC019255 | gi\|17939424\|gb\|BC019255.1BC019255 *Homo sapiens*, multifunctional polypeptide similar to SAICAR synthetase and AIR carboxylase, clone | 2.3E−260 |
| 3972 | RG:1862584:20001:G03 | MA139:G03 | 0.72829 | | | |
| 3973 | M00056585D:D05 | MA174:A09 | | BC007989 | gi\|14124931\|gb\|BC007989.1BC007989 *Homo sapiens*, Similar to heat shock 90 kD protein 1, alpha, clone IMAGE: 3030617, mRNA, partial cds | 1.3E−283 |
| 3974 | M00056586C:B08 | MA174:B09 | | BC013873 | gi\|15530196\|gb\|BC013873.1BC013873 *Homo sapiens*, Similar to centrin, EF-hand protein, 2, clone MGC: 10365 IMAGE: 3836808, mRNA, comple | 1.2E−184 |
| 3975 | M00056592A:B08 | MA174:E09 | | AB018580 | gi\|6624210\|dbj\|AB018580.1AB018580 *Homo sapiens* mRNA for hluPGFS, complete cds | 7.8E−251 |
| 3976 | RG:378550:10009:C03 | MA158:C03 | | | | |
| 3977 | RG:789040:10011:F09 | MA160:F09 | | M14676 | gi\|338227\|gb\|M14676.1HUMSLK Human src-like kinase (slk) mRNA, complete cds | 1E−300 |
| 3978 | M00057283A:D01 | MA182:B03 | | AF283772 | gi\|10281741\|gb\|AF283772.2AF283772 *Homo sapiens* clone TCBAP0781 mRNA sequence | 2.5E−266 |
| 3979 | M00043505A:E07 | MA184:D03 | | NM_007209 | gi\|16117792\|ref\|NM_007209.2 *Homo sapiens* ribosomal protein L35 (RPL35), mRNA | 5.5E−258 |
| 3980 | M00043506B:G10 | MA184:G03 | | BC007945 | gi\|14044036\|gb\|BC007945.1BC007945 *Homo sapiens*, ribosomal protein S11, clone MGC: 14322 IMAGE: 4297932, mRNA, complete cds | 1E−197 |
| 3981 | M00043507A:B02 | MA184:H03 | | | | |
| 3982 | M00042353C:F02 | MA182:A09 | | NM_001015 | gi\|14277698\|ref\|NM_001015.2 *Homo sapiens* ribosomal protein S11 (RPS11), mRNA | 3.4E−256 |

TABLE 32-continued

| SEQ ID NO | Clone ID | MAClone ID | Mask Prcnt | GBHit | GBDescription | GBScore |
|---|---|---|---|---|---|---|
| 3983 | M00054516B:A08 | MA184:F09 | | BC004459 | gi\|13325289\|gb\|BC004459.1BC004459 *Homo sapiens*, eukaryotic translation initiation factor 4E binding protein 1, clone MGC: 4316 IMAGE | 5E−280 |
| 3984 | M00054986D:B04 | MA198:A09 | | AJ131712 | gi\|7576251\|emb\|AJ131712.1HSA131712 *Homo sapiens* mRNA for nucleolar RNA-helicase (noH61 gene) | 1.2E−168 |
| 3985 | M00054987C:B10 | MA198:B09 | 0.09792 | AF097362 | gi\|6165617\|gb\|AF097362.1AF097362 *Homo sapiens* gamma-interferon inducible lysosomal thiol reductase (GILT) mRNA, complete cds | 9.1E−139 |
| 3986 | M00054988D:B11 | MA198:C09 | | BC019051 | gi\|17403061\|gb\|BC019051.1BC019051 *Homo sapiens*, clone IMAGE: 4636237, mRNA | 1.8E−192 |
| 3987 | M00055743C:G08 | MA170:E03 | | BC018970 | gi\|17512000\|gb\|BC018970.1BC018970 *Homo sapiens*, ribosomal protein L11, clone MGC: 19586 IMAGE: 4337066, mRNA, complete cds | 2.8E−216 |
| 3988 | M00055196B:C09 | MA196:D03 | | BC018755 | gi\|17511806\|gb\|BC018755.1BC018755 *Homo sapiens*, PDZ and LIM domain 1 (elfin), clone MGC: 31954 IMAGE: 3610938, mRNA, complete cds | 6.7E−242 |
| 3989 | M00055238B:G05 | MA196:B09 | | NM_012423 | gi\|14591905\|ref\|NM_012423.2 *Homo sapiens* ribosomal protein L13a (RPL13A), mRNA | 3.8E−206 |
| 3990 | M00056207B:H06 | MA180:G09 | 0.89703 | | | |
| 3991 | M00055966C:G04 | MA179:A03 | | BC008492 | gi\|14250147\|gb\|BC008492.1BC008492 *Homo sapiens*, ribosomal protein L3, clone MGC: 14821 IMAGE: 4251511, mRNA, complete cds | 8.2E−282 |
| 3992 | M00056920D:C08 | MA177:A03 | | BC014301 | gi\|15679985\|gb\|BC014301.1BC014301 *Homo sapiens*, Similar to enhancer of rudimentary (*Drosophila*) homolog, clone MGC: 1509 IMAGE: 35072 | 8.8E−204 |
| 3993 | M00055969D:D01 | MA179:C03 | 0.16904 | X73501 | gi\|402644\|emb\|X73501.1HSCYTOK20 *H. sapiens* gene for cytokeratin 20 | 4E−225 |
| 3994 | M00056055D:F06 | MA179:E09 | | AY011168 | gi\|12699140\|gb\|AY011168.1 *Homo sapiens* 16S ribosomal RNA gene, partial sequence; mitochondrial gene for mitochondrial product | 5.4E−149 |
| 3995 | M00056956B:G12 | MA177:E09 | 0.87013 | | | |
| 3996 | M00056060D:C04 | MA179:F09 | | V00710 | gi\|13683\|emb\|V00710.1MIT1HS Human mitochondrial genes for several tRNAs (Phe, Val, Leu) and 12S and 16S ribosomal RNAs | 4E−184 |
| 3997 | M00056061C:H04 | MA179:G09 | | U14528 | gi\|549987\|gb\|U14528.1HSU14528 Human sulfate transporter (DTD) mRNA, complete cds | 3.4E−219 |
| 3998 | M00054743C:E05 | MA188:A03 | | BC001603 | gi\|12804402\|gb\|BC001603.1BC001603 *Homo sapiens*, Similar to ribosomal protein L21, clone MGC: 2150 IMAGE: 3543702, mRNA, complete cds | 2.3E−179 |
| 3999 | M00054744C:B02 | MA188:B03 | | NM_033643 | gi\|16117795\|ref\|NM_033643.1 *Homo sapiens* ribosomal protein L36 (RPL36), transcript variant 1, mRNA | 6.2E−92 |
| 4000 | M00054808A:E02 | MA188:C09 | | BC003030 | gi\|12804340\|gb\|BC003030.1BC003030 *Homo sapiens*, heat shock 60 kD protein 1 (chaperonin), clone MGC: 4335 IMAGE: 2821157, mRNA, complet | 5.5E−174 |
| 4001 | M00054811A:G01 | MA188:G09 | | X90583 | gi\|1071680\|emb\|X90583.1HSRNATRAP *H. sapiens* mRNA for rat translocon-associated protein delta homolog | 3.9E−184 |
| 4002 | M00054797C:G10 | MA168:A03 | | BC004983 | gi\|13436415\|gb\|BC004983.1BC004983 *Homo sapiens*, nuclear factor of kappa light polypeptide gene enhancer in B-cells inhibitor, alpha | 2.1E−148 |
| 4003 | M00042843B:H01 | MA172:A03 | | AF068754 | gi\|3283408\|gb\|AF068754.1AF068754 *Homo sapiens* heat shock factor binding protein 1 HSBP1 mRNA, complete cds | 7.8E−139 |
| 4004 | M00042844D:D10 | MA172:D03 | | BC000483 | gi\|12653424\|gb\|BC000483.1BC000483 *Homo sapiens*, clone MGC: 8704 IMAGE: 2964733, mRNA, complete cds | 2.3E−232 |
| 4005 | M00042845D:A12 | MA172:E03 | | BC008329 | gi\|14249899\|gb\|BC008329.1BC008329 *Homo sapiens*, clone MGC: 15787 IMAGE: 3504130, mRNA, complete cds | 8.5E−229 |

TABLE 32-continued

| SEQ ID NO | Clone ID | MAClone ID | Mask Prcnt | GBHit | GBDescription | GBScore |
|---|---|---|---|---|---|---|
| 4006 | M00054800C:H10 | MA168:G03 | | Z85052 | gi\|1834763\|emb\|Z85052.1HSZ85052 *H. sapiens* Ig lambda light chain variable region gene (26-34ITIIIF120) rearranged; Ig-Light-Lambda; | 9E-167 |
| 4007 | M00054911D:E09 | MA168:H03 | | NM_000969 | gi\|14591908\|ref\|NM_000969.2 *Homo sapiens* ribosomal protein L5 (RPL5), mRNA | 7.2E-217 |
| 4008 | M00055450A:G03 | MA168:A09 | 0.09821 | AF074331 | gi\|5052074\|gb\|AF074331.1AF074331 *Homo sapiens* PAPS synthetase-2 (PAPSS2) mRNA, complete cds | 6.8E-152 |
| 4009 | M00055456B:H05 | MA168:D09 | 0.79701 | | | |
| 4010 | M00056733C:D03 | MA175:D03 | | X97336 | gi\|1666193\|emb\|X97336.1RUMTGENOM Rhinoceros unicornis complete mitochondrial genome | 3.1E-72 |
| 4011 | M00056737D:E08 | MA175:H03 | | D11094 | gi\|219930\|dbj\|D11094.1HUMMSS1 Human mRNA for MSS1, complete cds | 5.9E-230 |
| 4012 | M00056809B:A12 | MA175:E09 | | L42345 | gi\|1160933\|gb\|L42345.1HUMHLAB44A *Homo sapiens* lymphocyte antigen HLA-B*4402 and HLA-B*5101 mRNA, exons 1-7, complete cds | 6E-152 |
| 4013 | M00056809D:C07 | MA175:G09 | | J03801 | gi\|187243\|gb\|J03801.1HUMLSZ Human lysozyme mRNA, complete cds with an Alu repeat in the 3' flank | 9.3E-207 |
| 4014 | RG:1664308:10014:F09 | MA163:F09 | | AF011497 | gi\|2286216\|gb\|AF011497.1AF011497 *Homo sapiens* guanine nucleotide binding protein alpha 11 subunit (G11) mRNA, complete cds | 0 |
| 4015 | M00043321A:G07 | MA183:B03 | | D49400 | gi\|1395161\|dbj\|D49400.1HUMVATPASE *Homo sapiens* mRNA for vacuolar ATPase, complete cds | 5.1E-280 |
| 4016 | M00054549A:F03 | MA185:C03 | 0.84052 | | | |
| 4017 | M00043381A:C08 | MA183:D09 | | NM_001012 | gi\|4506742\|ref\|NM_001012.1 *Homo sapiens* ribosomal protein S8 (RPS8), mRNA | 1.1E-231 |
| 4018 | M00056642B:G03 | MA186:A03 | | BC010952 | gi\|15012094\|gb\|BC010952.1BC010952 *Homo sapiens*, Similar to protease inhibitor 3, skin-derived (SKALP), clone MGC: 13613 IMAGE: 408315 | 1E-300 |
| 4019 | M00056688C:A07 | MA186:H09 | | D13748 | gi\|219402\|dbj\|D13748.1HUM4AI Human mRNA for eukaryotic initiation factor 4AI | 1E-300 |
| 4020 | M00056257C:G03 | MA181:A04 | | AK054673 | gi\|16549265\|dbj\|AK054673.1AK054673 *Homo sapiens* cDNA FL130111 fis, clone BNGH42000360, highly similar to 3-KETOACYL-COA THIOLASE MI | 3.6E-228 |
| 4021 | M00055545C:F11 | MA169:G04 | | AY029066 | gi\|14017398\|gb\|AY029066.1 *Homo sapiens* Humanin (HN1) mRNA, complete cds | 1.4E-258 |
| 4022 | M00055653C:F04 | MA169:C10 | | M10050 | gi\|182355\|gb\|M10050.1HUMFABPL Human liver fatty acid binding protein (FABP) mRNA, complete cds | 5E-224 |
| 4023 | M00055653D:F01 | MA169:D10 | | M10050 | gi\|182355\|gb\|M10050.1HUMFABPL Human liver fatty acid binding protein (FABP) mRNA, complete cds | 1.9E-167 |
| 4024 | M00055385A:C11 | MA197:B10 | | BC013231 | gi\|15301504\|gb\|BC013231.1BC013231 *Homo sapiens*, clone IMAGE: 3462987, mRNA | 2.9E-244 |
| 4025 | M00056157A:F11 | MA180:D04 | | X74104 | gi\|452756\|emb\|X74104.1HSSSR *H. sapiens* mRNA for TRAP beta subunit | 4.5E-274 |
| 4026 | M00056160A:F03 | MA180:E04 | 0.89209 | | | |
| 4027 | M00056426A:H07 | MA173:F04 | 0.49541 | | | |
| 4028 | M00056214C:B04 | MA180:C10 | | Y00339 | gi\|29586\|emb\|Y00339.1HSCA2 Human mRNA for carbonic anhydrase II (EC 4.2.1.1) | 3E-222 |
| 4029 | M00056216A:F10 | MA180:D10 | 0.75335 | | | |
| 4030 | M00056507A:G11 | MA173:G10 | 0.71615 | | | |
| 4031 | M00054648C:C10 | MA187:A04 | | BC004113 | gi\|13278665\|gb\|BC004113.1BC004113 *Homo sapiens*, Similar to non-POU-domain-containing, octamer-binding, clone IMAGE: 3835400, mRNA, p | 1.6E-236 |
| 4032 | M00054862A:H11 | MA189:A04 | 0.60181 | | | |
| 4033 | M00054648D:F12 | MA187:B04 | | BC001118 | gi\|12654566\|gb\|BC001118.1BC001118 *Homo sapiens*, Similar to seven transmembrane domain protein, clone MGC: 1936 IMAGE: 2989840, mRNA, | 1.5E-289 |

TABLE 32-continued

| SEQ ID NO | Clone ID | MAClone ID | Mask Prcnt | GBHit | GBDescription | GBScore |
|---|---|---|---|---|---|---|
| 4034 | M00054650C:H08 | MA187:D04 | | AB026723 | gi\|5931601\|dbj\|AB026723.1AB026723 *Homo sapiens* SID6-8061 mRNA for pyrophosphatase, complete cds | 1.6E−295 |
| 4035 | M00054868C:C11 | MA189:H04 | 0.09703 | | | |
| 4036 | M00054700C:E02 | MA187:D10 | | BC000530 | gi\|12653516\|gb\|BC000530.1BC000530 *Homo sapiens*, ribosomal protein L19, clone MGC: 8653 IMAGE: 2961653, mRNA, complete cds | 2.9E−244 |
| 4037 | M00054902D:G11 | MA189:F10 | 0.71088 | | | |
| 4038 | M00054903B:G06 | MA189:G10 | | BC013231 | gi\|15301504\|gb\|BC013231.1BC013231 *Homo sapiens*, clone IMAGE: 3462987, mRNA | 1.1E−240 |
| 4039 | M00054706A:D05 | MA187:H10 | | AB060236 | gi\|13676490\|dbj\|AB060236.1AB060236 *Macaca fascicularis* brain cDNA clone: QflA-11918, full insert sequence | 6.9E−71 |
| 4040 | M00057207A:D05 | MA193:C04 | | AF127763 | gi\|6138993\|gb\|AF127763.2AF127763 *Homo sapiens* mitogenic oxidase mRNA, complete cds | 2.7E−297 |
| 4041 | M00057207C:F06 | MA193:D04 | | BC016756 | gi\|16876963\|gb\|BC016756.1BC016756 *Homo sapiens*, glutathione peroxidase 2 (gastrointestinal), clone IMAGE: 3681457, mRNA | 9.4E−291 |
| 4042 | M00057208B:F11 | MA193:F04 | | X60489 | gi\|31099\|emb\|X60489.1HSEF1B Human mRNA for elongation factor-1-beta | 8E−279 |
| 4043 | M00057242B:B10 | MA193:C10 | | J03464 | gi\|179595\|gb\|J03464.1HUMC1A2 Human collagen alpha-2 type I mRNA, complete cds, clone pHCOL2A1 | 2.1E−282 |
| 4044 | M00042555A:E06 | MA167:C04 | 0.79249 | | | |
| 4045 | M00042561A:H03 | MA167:D04 | | AK057546 | gi\|16553292\|dbj\|AK057546.1AK057546 *Homo sapiens* cDNA FLJ32984 fis, clone THYMU1000017, highly similar to *Homo sapiens* splice varian | 3.1E−278 |
| 4046 | M00042756C:E10 | MA171:E04 | | NM_005348 | gi\|13129149\|ref\|NM_005348.1 *Homo sapiens* heat shock 90 kD protein 1, alpha (HSPCA), mRNA | 3E−222 |
| 4047 | M00042758D:F01 | MA171:F04 | | NM_000969 | gi\|14591908\|ref\|NM_000969.2 *Homo sapiens* ribosomal protein L5 (RPL5), mRNA | 3.7E−259 |
| 4048 | M00042759B:E02 | MA171:H04 | | BC000077 | gi\|12652658\|gb\|BC000077.1BC000077 *Homo sapiens*, ribosomal protein L8, clone MGC: 3253 IMAGE: 3506015, mRNA, complete cds | 5.1E−252 |
| 4049 | M00042808D:D03 | MA171:B10 | | AB048207 | gi\|15425668\|dbj\|AB048207.1AB048207 *Homo sapiens* mRNA for TIGA1, complete cds | 2.2E−257 |
| 4050 | M00042808D:D10 | MA171:C10 | | AK026166 | gi\|10438929\|dbj\|AK026166.1AK026166 *Homo sapiens* cDNA: FLJ22513 fis, clone HRC12111, highly similar to HUMKUP Human Ku (p70/p80) sub | 9.5E−263 |
| 4051 | M00042811B:A05 | MA171:D10 | | AK027191 | gi\|10440260\|dbj\|AK027191.1AK027191 *Homo sapiens* cDNA: FLJ23538 fis, clone LNG08010, highly similar to BETA2 Human MEN1 region clone | 1.6E−121 |
| 4052 | M00042746B:F05 | MA167:E10 | | AK026528 | gi\|10439405\|dbj\|AK026528.1AK026528 *Homo sapiens* cDNA: FLJ22875 fis, clone KAT02879 | 1.6E−77 |
| 4053 | M00042746C:D01 | MA167:G10 | | BC000551 | gi\|12653554\|gb\|BC000551.1BC000551 *Homo sapiens*, lysophospholipase-like, clone MGC: 1216 IMAGE: 3163689, mRNA, complete cds | 5E−128 |
| 4054 | M00042812D:B04 | MA171:G10 | | NM_000978 | gi\|14591907\|ref\|NM_000978.2 *Homo sapiens* ribosomal protein L23 (RPL23), mRNA | 3.5E−256 |
| 4055 | M00056546B:F12 | MA174:A04 | | AK026570 | gi\|10439452\|dbj\|AK026570.1AK026570 *Homo sapiens* cDNA: FLJ22917 fis, clone KAT06430 | 2.1E−226 |
| 4056 | M00056550A:G09 | MA174:H04 | | X14420 | gi\|30057\|emb\|X14420.1HSCOL3AI Human mRNA for pro-alpha-1 type 3 collagen | 5.1E−165 |
| 4057 | M00056610C:B08 | MA174:G10 | | D87667 | gi\|1620019\|dbj\|D87667.1D87667 Human brain mRNA homologous to 3'UTR of human CD24 gene, partial sequence | 1.4E−199 |
| 4058 | RG:745556:10011:B04 | MA160:B04 | | AK056676 | gi\|16552146\|dbj\|AK056676.1AK056676 *Homo sapiens* cDNA FLJ32114 fis, clone OCBBF2001706 | 8.7E−227 |

TABLE 32-continued

| SEQ ID NO | Clone ID | MAClone ID | Mask Prcnt | GBHit | GBDescription | GBScore |
|---|---|---|---|---|---|---|
| 4059 | RG:446537:10009:G04 | MA158:G04 | | BC001430 | gi\|12655150\|gb\|BC001430.1BC001430 *Homo sapiens*, POP7 (processing of precursor, S. cerevisiae) homolog, clone MGC: 1986 IMAGE: 3138336 | 0 |
| 4060 | RG:375937:10009:B10 | MA158:B10 | | BC010153 | gi\|14603405\|gb\|BC010153.1BC010153 *Homo sapiens*, cyclin-dependent kinase 4, clone MGC: 19704 IMAGE: 3531300, mRNA, complete cds | 1.1E−77 |
| 4061 | RG:755120:10011:B10 | MA160:B10 | | BC016725 | gi\|16876888\|gb\|BC016725.1BC016725 *Homo sapiens*, 60S ribosomal protein L30 isolog, clone MGC: 24451 IMAGE: 4078305, mRNA, complete cds | 3.5E−52 |
| 4062 | RG:781108:10011:D10 | MA160:D10 | | | | |
| 4063 | M00042450C:H10 | MA182:A10 | | S56985 | gi\|298485\|gb\|S56985.1S56985 ribosomal protein L19 [human, breast cancer cell line, MCF-7, mRNA, 690 nt] | 1.4E−258 |
| 4064 | M00042451B:B05 | MA182:B10 | | BC013231 | gi\|15301504\|gb\|BC013231.1BC013231 *Homo sapiens*, clone IMAGE: 3462987, mRNA | 1.7E−239 |
| 4065 | M00054517D:D12 | MA184:B10 | | NM_000661 | gi\|15431302\|ref\|NM_000661.2 *Homo sapiens* ribosomal protein L9 (RPL9), mRNA | 1E−156 |
| 4066 | M00055002B:G06 | MA198:D10 | | J04164 | gi\|177801\|gb\|J04164.1HUM927A Human interferon-inducible protein 9-27 mRNA, complete cds | 1.5E−177 |
| 4067 | M00055749A:C09 | MA170:B04 | 0.08723 | M36532 | gi\|179794\|gb\|M36532.1HUMCAIZ Human carbonic anhydrase II mRNA, complete cds | 1.8E−236 |
| 4068 | M00055750A:F10 | MA170:D04 | | X57809 | gi\|33714\|emb\|X57809.1HSIGVL009 Human rearranged immunoglobulin lambda light chain mRNA | 4.1E−178 |
| 4069 | M00055757A:H06 | MA170:G04 | | M12759 | gi\|532596\|gb\|M12759.1HUMIGJ02 Human Ig J chain gene, exons 3 and 4 | 2.6E−104 |
| 4070 | M00055200B:F03 | MA196:D04 | | AK056446 | gi\|16551850\|dbj\|AK056446.1AK056446 *Homo sapiens* cDNA FLJ31884 fis, clone NT2RP7002906, highly similar to HEAT SHOCK PROTEIN HSP 90- | 2.3E−232 |
| 4071 | M00055203B:F05 | MA196:F04 | | NM_000979 | gi\|15431298\|ref\|NM_000979.2 *Homo sapiens* ribosomal protein L18 (RPL18), mRNA | 3.8E−262 |
| 4072 | M00055980B:F12 | MA179:E04 | | AK000140 | gi\|7020034\|dbj\|AK000140.1AK000140 *Homo sapiens* cDNA FLJ20133 fis, clone COL06539 | 6.8E−270 |
| 4073 | M00056066C:H10 | MA179:B10 | 0.89137 | | | |
| 4074 | M00056067B:F12 | MA179:C10 | | BC011836 | gi\|15080121\|gb\|BC011836.1BC011836 *Homo sapiens*, clone IMAGE: 3945177, mRNA | 7.1E−273 |
| 4075 | M00056075D:H10 | MA179:D10 | | AK027140 | gi\|10440192\|dbj\|AK027140.1AK027140 *Homo sapiens* cDNA: FLJ23487 fis, clone LNG00423 | 3.3E−200 |
| 4076 | M00056962D:A05 | MA177:D10 | | BC017366 | gi\|16924194\|gb\|BC017366.1BC017366 *Homo sapiens*, clone MGC: 1191 IMAGE: 3506054, mRNA, complete cds | 2.4E−91 |
| 4077 | M00056081D:B09 | MA179:E10 | | AF346964 | gi\|13272570\|gb\|AF346964.1AF346964 *Homo sapiens* mitochondrion, complete genome | 1.9E−93 |
| 4078 | M00056963A:E01 | MA177:E10 | | BC000999 | gi\|12803040\|gb\|BC000999.2BC000999 *Homo sapiens*, Similar to transforming, acidic coiled-coil containing protein 2, clone IMAGE: 29849 | 1.9E−276 |
| 4079 | M00056081D:C02 | MA179:F10 | | V00710 | gi\|13683\|emb\|V00710.1MIT1HS Human mitochondrial genes for several tRNAs (Phe, Val, Leu) and 12S and 16S ribosomal RNAs | 1.3E−97 |
| 4080 | M00056964D:C08 | MA177:G10 | | M36072 | gi\|337494\|gb\|M36072.1HUMRPL7A Human ribosomal protein L7a (surf 3) large subunit mRNA, complete cds | 1.8E−245 |
| 4081 | M00056084A:B08 | MA179:H10 | | U67963 | gi\|1763010\|gb\|U67963.1HSU67963 Human lysophospholipase homolog (HU-K5) mRNA, complete cds | 2.3E−136 |
| 4082 | M00054750C:G08 | MA188:B04 | | BC001125 | gi\|12654578\|gb\|BC001125.1BC001125 *Homo sapiens*, peptidylprolyl isomerase B (cyclophilin B), clone MGC: 2224 IMAGE: 2966791, mRNA, com | 1.1E−190 |

TABLE 32-continued

| SEQ ID NO | Clone ID | MAClone ID | Mask Prcnt | GBHit | GBDescription | GBScore |
|---|---|---|---|---|---|---|
| 4083 | M00054750D:F04 | MA188:C04 | | U30246 | gi\|903681\|gb\|U30246.1HSU30246 Human bumetanide-sensitive Na-K-Cl cotransporter (NKCC1) mRNA, complete cds | 3E−247 |
| 4084 | M00054757A:F05 | MA188:G04 | | U86602 | gi\|1835785\|gb\|U86602.1HSU86602 Human nucleolar protein p40 mRNA, complete cds | 1E−300 |
| 4085 | M00054760D:B10 | MA188:H04 | | BC014788 | gi\|15928638\|gb\|BC014788.1BC014788 *Homo sapiens*, guanine nucleotide binding protein (G protein), beta polypeptide 2-like 1, clone MG | 1E−300 |
| 4086 | M00042847A:A04 | MA172:A04 | | M61831 | gi\|178276\|gb\|M61831.1HUMAHCY Human S-adenosylhomocysteine hydrolase (AHCY) mRNA, complete cds | 5.5E−230 |
| 4087 | M00042847A:D10 | MA172:B04 | 0.82393 | | | |
| 4088 | M00054917B:G02 | MA168:F04 | | J04164 | gi\|177801\|gb\|J04164.1HUM927A Human interferon-inducible protein 9-27 mRNA, complete cds | 6.4E−239 |
| 4089 | M00055468D:D05 | MA168:C10 | | BC001781 | gi\|12804704\|gb\|BC001781.1BC001781 *Homo sapiens*, ribosomal protein L44, clone MGC: 2064 IMAGE: 3353669, mRNA, complete cds | 2.2E−173 |
| 4090 | M00055469B:E11 | MA168:D10 | 0.52048 | U07969 | gi\|483391\|gb\|U07969.1HSU07969 Human intestinal peptide-associated transporter HPT-1 mRNA, complete cds | 7.2E−103 |
| 4091 | M00055492C:C01 | MA168:G10 | | BC003394 | gi\|13097278\|gb\|BC003394.1BC003394 *Homo sapiens*, heterogeneous nuclear ribonucleoprotein C (C1/C2), clone MGC: 5418 IMAGE: 3447724, mR | 3.2E−253 |
| 4092 | M00055496A:E06 | MA168:H10 | 0.86834 | | | |
| 4093 | M00056742D:D01 | MA175:F04 | | U51924 | gi\|1263307\|gb\|U51924.1HSU51924 Human phosphatase 2A inhibitor I2PP2A mRNA, complete cds | 1.3E−199 |
| 4094 | M00056814D:C08 | MA175:G10 | | BC000472 | gi\|12653404\|gb\|BC000472.1BC000472 *Homo sapiens*, ribosomal protein S4, X-linked, clone MGC: 8636 IMAGE: 2961540, mRNA, complete cds | 2.4E−291 |
| 4095 | RG:1636303:10014:B10 | MA163:B10 | | AJ338808 | gi\|15883226\|emb\|AJ338808.1HSA338808 *Homo sapiens* genomic sequence surrounding NotI site, clone NR1-QA13R | 0 |
| 4096 | RG:1643142:10014:C10 | MA163:C10 | | U14528 | gi\|549987\|gb\|U14528.1HSU14528 Human sulfate transporter (DTD) mRNA, complete cds | 5.6E−138 |
| 4097 | RG:1650444:10014:D10 | MA163:D10 | | D10040 | gi\|219899\|dbj\|D10040.1HUMLCACS *Homo sapiens* mRNA for long-chain acyl-CoA synthetase, complete cds | 0 |
| 4098 | RG:1418984:10003:H10 | MA152:H10 | | X52967 | gi\|36139\|emb\|X52967.1HSRPL7 Human mRNA for ribosomal protein L7 | 1E−300 |
| 4099 | M00043339C:C12 | MA183:A04 | | X60489 | gi\|31099\|emb\|X60489.1HSEF1B Human mRNA for elongation factor-1-beta | 7E−270 |
| 4100 | M00043342C:H03 | MA183:B04 | | AK026558 | gi\|10439440\|dbj\|AK026558.1AK026558 *Homo sapiens* cDNA: FLJ22905 fis, clone KAT05654, highly similar to HUMRPL18A *Homo sapiens* riboso | 4.1E−159 |
| 4101 | M00043350A:C04 | MA183:D04 | | BC004324 | gi\|13279235\|gb\|BC004324.1BC004324 *Homo sapiens*, ribosomal protein S16, clone MGC: 10931 IMAGE: 3628799, mRNA, complete cds | 3.7E−231 |
| 4102 | M00056646D:G05 | MA186:B04 | | BC018190 | gi\|17390422\|gb\|BC018190.1BC018190 *Homo sapiens*, Similar to metallothionein 1L, clone MGC: 9187 IMAGE: 3859643, mRNA, complete cds | 3.4E−172 |
| 4103 | M00055406C:H08 | MA199:D04 | | AF078861 | gi\|5531836\|gb\|AF078861.1AF078861 *Homo sapiens* PTD008 mRNA, complete cds | 1.8E−192 |
| 4104 | M00056653C:F06 | MA186:H04 | | BC005354 | gi\|13529169\|gb\|BC005354.1BC005354 *Homo sapiens*, ribosomal protein, large P2, clone MGC: 12453 IMAGE: 4052568, mRNA, complete cds | 1.6E−264 |
| 4105 | M00055408A:H06 | MA199:H04 | | AF054183 | gi\|4092053\|gb\|AF054183.1AF054183 *Homo sapiens* GTP binding protein mRNA, complete cds | 1E−187 |

TABLE 32-continued

| SEQ ID NO | Clone ID | MAClone ID | Mask Prcnt | GBHit | GBDescription | GBScore |
|---|---|---|---|---|---|---|
| 4106 | M00055545D:E02 | MA169:A05 | | BC009699 | gi|16307220|gb|BC009699.1BC009699 *Homo sapiens*, Similar to RNA helicase-related protein, clone MGC: 9246 IMAGE: 3892441, mRNA, comple | 5E−224 |
| 4107 | M00055548B:H07 | MA169:C05 | | AF105253 | gi|7532779|gb|AF105253.1AF105253 *Homo sapiens* neuroendocrine secretory protein 55 mRNA, complete cds | 4.2E−268 |
| 4108 | M00056271C:F02 | MA181:D05 | | BC008323 | gi|14249887|gb|BC008323.1BC008323 *Homo sapiens*, clone MGC: 15764 IMAGE: 3358085, mRNA, complete cds | 5.8E−202 |
| 4109 | M00055550D:A05 | MA169:F05 | | AF130094 | gi|11493492|gb|AF130094.1AF130094 *Homo sapiens* clone FLC0165 mRNA sequence | 3.4E−225 |
| 4110 | M00055661A:F09 | MA169:E11 | | | | |
| 4111 | M00056427D:A09 | MA173:B05 | | U07550 | gi|469170|gb|U07550.1HSU07550 Human chaperonin 10 mRNA, complete cds | 2E−145 |
| 4112 | M00056163C:H09 | MA180:B05 | | AF201944 | gi|9295191|gb|AF201944.1AF201944 *Homo sapiens* HGTD-P (HGTD-P) mRNA, complete cds | 2.2E−285 |
| 4113 | M00056428B:F07 | MA173:C05 | | U30246 | gi|903681|gb|U30246.1HSU30246 Human bumetanide-sensitive Na—K—Cl cotransporter (NKCC1) mRNA, complete cds | 9.7E−126 |
| 4114 | M00056163D:E01 | MA180:C05 | | BC001829 | gi|12804776|gb|BC001829.1BC001829 *Homo sapiens*, lactate dehydrogenase A, clone MGC: 4065 IMAGE: 2960999, mRNA, complete cds | 4.4E−240 |
| 4115 | M00056428C:A12 | MA173:E05 | | NM_001016 | gi|14277699|ref|NM_001016.2 *Homo sapiens* ribosomal protein S12 (RPS12), mRNA | 4.2E−212 |
| 4116 | M00056429D:D07 | MA173:F05 | 0.53763 | | | |
| 4117 | M00056175D:B05 | MA180:G05 | | Z62862 | gi|1035240|emb|Z62862.1HS74B1R *H. sapiens* CpG island DNA genomic Mse1 fragment, clone 74b1, reverse read cpg74b1.rt1a | 6.9E−87 |
| 4118 | M00056507D:D04 | MA173:A11 | 0.65197 | | | |
| 4119 | M00056511D:H07 | MA173:F11 | | BC000419 | gi|12653300|gb|BC000419.1BC000419 *Homo sapiens*, catechol-O-methyltransferase, clone MGC: 8663 IMAGE: 2964400, mRNA, complete cds | 6.1E−205 |
| 4120 | M00054654A:F12 | MA187:A05 | | NM_000976 | gi|15431291|ref|NM_000976.2 *Homo sapiens* ribosomal protein L12 (RPL12), mRNA | 1E−296 |
| 4121 | M00054868D:F12 | MA189:A05 | | NM_012423 | gi|14591905|ref|NM_012423.2 *Homo sapiens* ribosomal protein L13a (RPL13A), mRNA | 4.4E−140 |
| 4122 | M00054661B:H10 | MA187:D05 | | L47277 | gi|986911|gb|L47277.1HUMTOPATRA *Homo sapiens* (cell line HepG2, HeLa) alpha topoisomerase truncated-form mRNA, 3'UTR | 5.8E−261 |
| 4123 | M00054666B:C07 | MA187:F05 | | AJ250229 | gi|8926686|emb|AJ250229.1HSA250229 *Homo sapiens* mRNA for chromosome 11 hypothetical protein (ORF1) | 6.1E−205 |
| 4124 | M00054870B:H05 | MA189:F05 | | M26326 | gi|186690|gb|M26326.1HUMKER18AA Human keratin 18 mRNA, complete cds | 4.8E−121 |
| 4125 | M00054669B:B03 | MA187:G05 | | BC001754 | gi|12804658|gb|BC001754.1BC001754 *Homo sapiens*, male-enhanced antigen, clone MGC: 2286 IMAGE: 3355279, mRNA, complete cds | 8E−192 |
| 4126 | M00054706B:G04 | MA187:A11 | | AF201944 | gi|9295191|gb|AF201944.1AF201944 *Homo sapiens* HGTD-P (HGTD-P) mRNA, complete cds | 8.3E−251 |
| 4127 | M00054720C:F01 | MA187:D11 | | BC013918 | gi|15530264|gb|BC013918.1BC013918 *Homo sapiens*, Similar to eukaryotic translation elongation factor 1 gamma, clone MGC: 22883 IMAGE: | 1.4E−224 |
| 4128 | M00054722B:E08 | MA187:E11 | | Z62862 | gi|1035240|emb|Z62862.1HS74B1R *H. sapiens* CpG island DNA genomic Mse1 fragment, clone 74b1, reverse read cpg74b1.rt1a | 6E−116 |
| 4129 | M00054908A:H08 | MA189:E11 | | L00160 | gi|189904|gb|L00160.1HUMPGK2 Human phosphoglycerate kinase (pgk) mRNA, exons 2 to last | 2.4E−291 |

TABLE 32-continued

| SEQ ID NO | Clone ID | MAClone ID | Mask Prcnt | GBHit | GBDescription | GBScore |
|---|---|---|---|---|---|---|
| 4130 | M00054723B:H12 | MA187:G11 | | X60819 | gi\|34458\|emb\|X60819.1HSMAOP14 H. sapiens DNA for monoamine oxidase type A (14) (partial) | 1.6E−295 |
| 4131 | M00057210B:G10 | MA193:C05 | | U12404 | gi\|5311701\|gb\|U12404.1HSU12404 Human Csa-19 mRNA, complete cds | 3.5E−175 |
| 4132 | M00057248D:B05 | MA193:B11 | | NM_001024 | gi\|14670385\|ref\|NM_001024.2 Homo sapiens ribosomal protein S21 (RPS21), mRNA | 1.3E−196 |
| 4133 | M00057252A:F06 | MA193:F11 | | AF035555 | gi\|3116433\|gb\|AF035555.1AF035555 Homo sapiens short chain L-3-hydroxyacyl-CoA dehydrogenase (SCHAD) mRNA, complete cds | 2.5E−182 |
| 4134 | M00042573B:A02 | MA167:B05 | | BC007583 | gi\|14043190\|gb\|BC007583.1BC007583 Homo sapiens, clone MGC: 15572 IMAGE: 3140342, mRNA, complete cds | 1.6E−102 |
| 4135 | M00042766A:E10 | MA171:F05 | | AF201944 | gi\|9295191\|gb\|AF201944.1AF201944 Homo sapiens HGTD-P (HGTD-P) mRNA, complete cds | 2.8E−244 |
| 4136 | M00042882D:G08 | MA167:A11 | | AF346964 | gi\|13272570\|gb\|AF346964.1AF346964 Homo sapiens mitochondrion, complete genome | 5.1E−199 |
| 4137 | M00042885C:A12 | MA167:B11 | | NM_001018 | gi\|14591911\|ref\|NM_001018.2 Homo sapiens ribosomal protein S15 (RPS15), mRNA | 1.9E−248 |
| 4138 | M00042815A:E07 | MA171:B11 | 0.781 | | | |
| 4139 | M00042817B:E11 | MA171:C11 | | AF077034 | gi\|4689115\|gb\|AF077034.1AF077034 Homo sapiens HSPC010 mRNA, complete cds | 5.6E−258 |
| 4140 | M00042887C:A07 | MA167:E11 | | X73502 | gi\|406853\|emb\|X73502.1HSENCY20 H. Sapiens mRNA for cytokeratin 20 | 2.1E−195 |
| 4141 | M00042818D:A08 | MA171:G11 | | NM_001002 | gi\|16933547\|ref\|NM_001002.2 Homo sapiens ribosomal protein, large, P0 (RPLP0), transcript variant 1, mRNA | 2E−251 |
| 4142 | M00056552A:G08 | MA174:C05 | | AK027892 | gi\|14042896\|dbj\|AK027892.1AK027892 Homo sapiens cDNA FLJ14986 fis, clone Y79AA1000784, highly similar to Homo sapiens RanBP7/import | 2.4E−291 |
| 4143 | M00056552C:D08 | MA174:D05 | | BC017831 | gi\|17389602\|gb\|BC017831.1BC017831 Homo sapiens, ribosomal protein L17, clone MGC: 22482 IMAGE: 4251433, mRNA, complete cds | 2E−279 |
| 4144 | M00056553C:E10 | MA174:E05 | | X14420 | gi\|30057\|emb\|X14420.1HSCOL3AI Human mRNA for pro-alpha-1 type 3 collagen | 5.8E−289 |
| 4145 | M00056555B:C11 | MA174:H05 | | M58458 | gi\|337509\|gb\|M58458.1HUMRPS4X Human ribosomal protein S4 (RPS4X) isoform mRNA, complete cds | 1.2E−196 |
| 4146 | M00056611C:D03 | MA174:D11 | | AF081192 | gi\|3420798\|gb\|AF081192.1AF081192 Homo sapiens histone H2A.F/Z variant (H2AV) mRNA, complete cds | 3.9E−293 |
| 4147 | M00056611D:B03 | MA174:F11 | | L06498 | gi\|292442\|gb\|L06498.1HUMRPS20 Homo sapiens ribosomal protein S20 (RPS20) mRNA, complete cds | 3.E−169 |
| 4148 | M00056611D:F08 | MA174:G11 | | M19645 | gi\|183644\|gb\|M19645.1HUMGRP78 Human 78 kdalton glucose-regulated protein (GRP78) gene, complete cds | 1.5E−289 |
| 4149 | M00056614C:F06 | MA174:H11 | | AB063318 | gi\|14517631\|dbj\|AB063318.1AB063318 Homo sapiens MoDP-2, MoDP-3 mRNA for acute morphine dependence related protein 2, acute morphine | 5.7E−230 |
| 4150 | RG:358387:10009:A05 | MA158:A05 | | BC014270 | gi\|15679933\|gb\|BC014270.1BC014270 Homo sapiens, protein kinase C, zeta, clone MGC: 10512 IMAGE: 3835020, mRNA, complete cds | 2.9E−266 |
| 4151 | M00057302A:F08 | MA182:A05 | | BC007097 | gi\|13937968\|gb\|BC007097.1BC007097 Homo sapiens, tissue inhibitor of metalloproteinase 1 (erythroid potentiating activity, collagena | 3.3E−147 |
| 4152 | M00057302C:H09 | MA182:C05 | | BC018210 | gi\|17390469\|gb\|BC018210.1BC018210 Homo sapiens, tubulin-specific chaperone a, clone MGC: 9129 IMAGE: 3861138, mRNA, complete cds | 2.1E−251 |

TABLE 32-continued

| SEQ ID NO | Clone ID | MAClone ID | Mask Prcnt | GBHit | GBDescription | GBScore |
|---|---|---|---|---|---|---|
| 4153 | M00054496A:B09 | MA184:F05 | 0.60245 | BC002589 | gi\|12803524\|gb\|BC002589.1BC002589 *Homo sapiens*, proteasome (prosome, macropain) 26S subunit, ATPase, 2, clone MGC: 3004 IMAGE: 316179 | 3.5E−64 |
| 4154 | M00054496A:H05 | MA184:H05 | | BC004138 | gi\|13278716\|gb\|BC004138.1BC004138 *Homo sapiens*, ribosomal protein L6, clone MGC: 1635 IMAGE: 2823733, mRNA, complete cds | 1.4E−286 |
| 4155 | M00042460B:A08 | MA182:A11 | | NM_000980 | gi\|15431299\|ref\|NM_000980.2 *Homo sapiens* ribosomal protein L18a (RPL18A), mRNA | 8.7E−229 |
| 4156 | M00054524B:B09 | MA184:A11 | | NM_000976 | gi\|15431291\|ref\|NM_000976.2 *Homo sapiens* ribosomal protein L12 (RPL12), mRNA | 4.1E−296 |
| 4157 | M00054526C:E05 | MA184:B11 | | NM_000988 | gi\|17017972\|ref\|NM_000988.2 *Homo sapiens* ribosomal protein L27 (RPL27), mRNA | 7E−189 |
| 4158 | M00042516B:A08 | MA182:C11 | | NM_000976 | gi\|15431291\|ref\|NM_000976.2 *Homo sapiens* ribosomal protein L12 (RPL12), mRNA | 2E−248 |
| 4159 | M00042517D:H10 | MA182:D11 | | BC000386 | gi\|12653234\|gb\|BC000386.1BC000386 *Homo sapiens*, eukaryotic translation initiation factor 3, subunit 3 (gamma, 40 kD), clone MGC: 8431 | 3.8E−178 |
| 4160 | M00054527B:H11 | MA184:D11 | | AF155235 | gi\|6318598\|gb\|AF155235.1AF155235 *Homo sapiens* 15.5 kD RNA binding protein mRNA, complete cds | 4.5E−240 |
| 4161 | M00042517D:H11 | MA182:E11 | | BC016756 | gi\|16876963\|gb\|BC016756.1BC016756 *Homo sapiens*, glutathione peroxidase 2 (gastrointestinal), clone IMAGE: 3681457, mRNA | 1.4E−230 |
| 4162 | M00054529C:G04 | MA184:G11 | | NM_022551 | gi\|14165467\|ref\|NM_022551.2 *Homo sapiens* ribosomal protein S18 (RPS18), mRNA | 2.7E−213 |
| 4163 | M00043300D:A06 | MA182:H11 | | BC012146 | gi\|15082460\|gb\|BC012146.1BC012146 *Homo sapiens*, Similar to ribosomal protein L3, clone MGC: 20359 IMAGE: 4549682, mRNA, complete cds | 3.6E−259 |
| 4164 | M00054958A:G10 | MA198:C05 | | AY007723 | gi\|15431041\|gb\|AY007723.1 *Homo sapiens* MAL2 proteolipid (MAL2) mRNA, complete cds | 2.6E−185 |
| 4165 | M00054958B:B07 | MA198:D05 | 0.12023 | AF012108 | gi\|2331249\|gb\|AF012108.1AF012108 *Homo sapiens* Amplified in Breast Cancer (AIB1) mRNA, complete cds | 2.6E−111 |
| 4166 | M00054961D:E08 | MA198:H05 | | NM_005617 | gi\|14141191\|ref\|NM_005617.2 *Homo sapiens* ribosomal protein S14 (RPS14), mRNA | 3.2E−172 |
| 4167 | M00055015C:H02 | MA198:C11 | | X58965 | gi\|35069\|X58965.1HSNM23H2G *H. sapiens* RNA for nm23-H2 gene | 4.4E−187 |
| 4168 | M00055016B:D03 | MA198:E11 | | NM_001010 | gi\|17158043\|ref\|NM_001010.2 *Homo sapiens* ribosomal protein S6 (RPS6), mRNA | 1.7E−186 |
| 4169 | M00055764D:D05 | MA170:E05 | | BC001708 | gi\|12804576\|gb\|BC001708.1BC001708 *Homo sapiens*, ribosomal protein S3A, clone MGC: 1626 IMAGE: 3544072, mRNA, complete cds | 9.8E−210 |
| 4170 | M00055815C:E08 | MA170:B11 | | AK025459 | gi\|10437979\|dbj\|AK025459.1AK025459 *Homo sapiens* cDNA: FLJ21806 fis, clone HEP00829, highly similar to HSTRA1 Human tra1 mRNA for hu | 4.8E−249 |
| 4171 | M00055819B:B12 | MA170:F11 | | AF014838 | gi\|2281706\|gb\|AF014838.1AF014838 *Homo sapiens* galectin-4 mRNA, complete cds | 8.3E−254 |
| 4172 | M00055820C:H11 | MA170:H11 | | NM_000967 | gi\|16507968\|ref\|NM_000967.2 *Homo sapiens* ribosomal protein L3 (RPL3), mRNA | 3.4E−175 |
| 4173 | M00055204B:C04 | MA196:A05 | | X57351 | gi\|311373\|emb\|X57351.1HS18D Human 1-8D gene from interferon-inducible gene family | 1.2E−218 |
| 4174 | M00055209A:C09 | MA196:D05 | | AF028832 | gi\|3287488\|gb\|AF028832.1AF028832 *Homo sapiens* Hsp89-alpha-delta-N mRNA, complete cds | 9.1E−232 |
| 4175 | M00055252C:G12 | MA196:D11 | 0.1038 | U16738 | gi\|608516\|gb\|U16738.1HSU16738 *Homo sapiens* CAG-isl 7 mRNA, complete cds | 1E−172 |

TABLE 32-continued

| SEQ ID NO | Clone ID | MAClone ID | Mask Prcnt | GBHit | GBDescription | GBScore |
|---|---|---|---|---|---|---|
| 4176 | M00056934C:D08 | MA177:A05 | | Z69043 | gi\|2398656\|emb\|Z69043.1HSTRAPRNA *H. sapiens* mRNA translocon-associated protein delta subunit precursor | 3.2E−281 |
| 4177 | M00055989C:D03 | MA179:B05 | 0.8 | | | |
| 4178 | M00056937C:G12 | MA177:D05 | | AK055020 | gi\|16549662\|dbj\|AK055020.1AK055020 *Homo sapiens* cDNA FLJ30458 fis, clone BRACE2009421, highly similar to NUCLEOSOME ASSEMBLY PROTEI | 3.2E−219 |
| 4179 | M00055997B:A02 | MA179:H05 | 0.89264 | | | |
| 4180 | M00056087A:G01 | MA179:C11 | | AF150754 | gi\|12484558\|gb\|AF150754.2AF150754 *Homo sapiens* 3'phosphoadenosine 5'-phosphosulfate synthase 2b isoform mRNA, complete cds | 2.4E−96 |
| 4181 | M00056091A:H05 | MA179:D11 | | BC013724 | gi\|15489238\|gb\|BC013724.1BC013724 *Homo sapiens*, ferritin, heavy polypeptide 1, clone MGC: 17255 IMAGE: 3857790, mRNA, complete cds | 3.9E−265 |
| 4182 | M00056966B:A05 | MA177:E11 | | AF346974 | gi\|13272710\|gb\|AF346974.1AF346974 *Homo sapiens* mitochondrion, complete genome | 5.6E−108 |
| 4183 | M00056093A:F08 | MA179:F11 | 0.26754 | | | |
| 4184 | M00056096C:H10 | MA179:H11 | 0.77419 | | | |
| 4185 | M00054766B:E10 | MA188:H05 | | BC005328 | gi\|13529103\|gb\|BC005328.1BC005328 *Homo sapiens*, ribosomal protein S27a, clone MGC: 12414, mRNA, complete cds | 5.8E−258 |
| 4186 | M00054817B:H09 | MA188:B11 | | BC015465 | gi\|15930040\|gb\|BC015465.1BC015465 *Homo sapiens*, HSPC023 protein, clone MGC: 8754 IMAGE: 3914049, mRNA, complete cds | 8.4E−254 |
| 4187 | M00054818D:G04 | MA188:D11 | | BC008495 | gi\|14250151\|gb\|BC008495.1BC008495 *Homo sapiens*, nucleophosmin (nucleolar phosphoprotein B23, numatrin), clone MGC: 14826 IMAGE: 42766 | 1.4E−258 |
| 4188 | M00042851D:H04 | MA172:A05 | | NM_001000 | gi\|16306563\|ref\|NM_001000.2 *Homo sapiens* ribosomal protein L39 (RPL39), mRNA | 3.7E−156 |
| 4189 | M00042853A:F01 | MA172:B05 | | NM_000970 | gi\|16753226\|ref\|NM_000970.2 *Homo sapiens* ribosomal protein L6 (RPL6), mRNA | 3.4E−284 |
| 4190 | M00055426A:G06 | MA168:E05 | | AF272149 | gi\|9971873\|gb\|AF272149.1AF272149 *Homo sapiens* hepatocellular carcinoma associated-gene TB6, mRNA sequence | 1.3E−61 |
| 4191 | M00055496A:G12 | MA168:B11 | | AF203815 | gi\|6979641\|gb\|AF203815.1AF203815 *Homo sapiens* alpha gene sequence | 5.6E−202 |
| 4192 | M00055509C:C02 | MA168:F11 | 0.76684 | AL590401 | gi\|14422235\|emb\|AL590401.6AL590401 Human DNA sequence from clone RP11-466P12 on chromosome 6, complete sequence [*Homo sapiens*] | 1.8E−35 |
| 4193 | M00055510B:F08 | MA168:G11 | | AF067174 | gi\|4894381\|gb\|AF067174.1AF067174 *Homo sapiens* retinol dehydrogenase homolog mRNA, complete cds | 2.2E−257 |
| 4194 | M00055510D:A08 | MA168:H11 | | AK026649 | gi\|10439547\|dbj\|AK026649.1AK026649 *Homo sapiens* cDNA: FLJ22996 fis, clone KAT11938 | 1.6E−161 |
| 4195 | M00056748C:B08 | MA175:B05 | | AF054183 | gi\|4092053\|gb\|AF054183.1AF054183 *Homo sapiens* GTP binding protein mRNA, complete cds | 1.2E−165 |
| 4196 | M00056749A:F01 | MA175:C05 | | Y14736 | gi\|2765422\|emb\|Y14736.1HSIGG1KL *Homo sapiens* mRNA for immunoglobulin kappa light chain | 1.2E−249 |
| 4197 | M00056754B:A10 | MA175:G05 | | V00710 | gi\|13683\|emb\|V00710.1MIT1HS Human mitochondrial genes for several tRNAs (Phe, Val, Leu) and 12S and 16S ribosomal RNAs | 6.3E−292 |
| 4198 | M00056754B:H06 | MA175:H05 | | D38112 | gi\|644480\|dbj\|D38112.1HUMMTA *Homo sapiens* mitochondrial DNA, complete sequence | 1.4E−252 |
| 4199 | RG:1653390:10014:E05 | MA163:E05 | | M15353 | gi\|306486\|gb\|M15353.1HUMIF4E *Homo sapiens* cap-binding protein mRNA, complete cds | 1.5E−138 |
| 4200 | RG:1669553:10014:G05 | MA163:G05 | | X03663 | gi\|29899\|emb\|X03663.1HSCFMS Human mRNA for c-fms proto-oncogene | 5.8E−221 |
| 4201 | M00043355A:H12 | MA183:B05 | | M94314 | gi\|292436\|gb\|M94314.1HUMRPL30A *Homo sapiens* ribosomal protein L30 mRNA, complete cds | 7.9E−66 |

TABLE 32-continued

| SEQ ID NO | Clone ID | MAClone ID | Mask Prcnt | GBHit | GBDescription | GBScore |
|---|---|---|---|---|---|---|
| 4202 | M00043355B:F10 | MA183:C05 | | AK055653 | gi\|16550433\|dbj\|AK055653,1AK055653 *Homo sapiens* cDNA FLJ31091 fis, clone IMR321000155, highly similar to 60S RIBOSOMAL PROTEIN L35A | 1.1E−165 |
| 4203 | M00043357B:B10 | MA183:G05 | | NM_000978 | gi\|14591907\|ref\|NM_000978.2 *Homo sapiens* ribosomal protein L23 (RPL23), mRNA | 3.7E−206 |
| 4204 | M00054557C:D09 | MA185:G05 | | NM_012423 | gi\|14591905\|ref\|NM_012423.2 *Homo sapiens* ribosomal protein L13a (RPL13A), mRNA | 9.6E−167 |
| 4205 | M00043358B:G11 | MA183:H05 | | M60854 | gi\|338446\|gb\|M60854.1HUMSRAA Human ribosomal protein S16 mRNA, complete cds | 5.2E−280 |
| 4206 | M00043396D:B04 | MA183:A11 | | AF026166 | gi\|4090928\|gb\|AF026166.1AF026166 *Homo sapiens* chaperonin-containing TCP-1 beta subunit homolog mRNA, complete cds | 4.1E−237 |
| 4207 | M00054612D:D11 | MA185:H11 | | NM_006013 | gi\|15718685\|ref\|NM_006013.2 *Homo sapiens* ribosomal protein L10 (RPL10), mRNA | 1.2E−171 |
| 4208 | M00055409B:D08 | MA199:A05 | | BC016748 | gi\|16876941\|gb\|BC016748.1BC016748 *Homo sapiens*, ribosomal protein L37a, clone MGC: 26772 IMAGE: 4831278, mRNA, complete cds | 3.6E−55 |
| 4209 | M00055409D:F06 | MA199:B05 | | V00572 | gi\|35434\|emb\|V00572.1HSPGK1 Human mRNA encoding phosphoglycerate kinase | 1.6E−186 |
| 4210 | M00055410A:A06 | MA199:C05 | 0.80422 | | | |
| 4211 | M00056659A:D08 | MA186:F05 | | M15470 | gi\|187680\|gb\|M15470.1HUMMHB44 Human MHC class I HLA-B44 mRNA, partial cds | 3E−275 |
| 4212 | M00056704C:H08 | MA186:D11 | | BC001125 | gi\|12654578\|gb\|BC001125.1BC001125 *Homo sapiens*, peptidylprolyl isomerase B (cyclophilin B), clone MGC: 2224 IMAGE:2966791, mRNA, com | 8.2E−282 |
| 4213 | M00055553C:B06 | MA169:A06 | | | | |
| 4214 | M00056280B:D10 | MA181:A06 | 0.72079 | | | |
| 4215 | M00056282D:G10 | MA181:C06 | 0.05211 | AJ420520 | gi\|17066384\|emb\|AJ420520.1HSA420520 *Homo sapiens* mRNA full length insert cDNA clone EUROIMAGE 1979495 | 1.5E−88 |
| 4216 | M00056288B:A12 | MA181:G06 | | D14530 | gi\|414348\|dbj\|D14530.1HUMRSPT Human homolog of yeast ribosomal protein S28, complete cds | 9.8E−23 |
| 4217 | M00055686D:E11 | MA169:B12 | | L02785 | gi\|291963\|gb\|L02785.1HUMDRA *Homo sapiens* colon mucosa-associated (DRA) mRNA, complete cds | 5.9E−202 |
| 4218 | M00042346B:F09 | MA181:C12 | 0.23093 | AK000168 | gi\|7020079\|dbj\|AK000168.1AK000168 *Homo sapiens* cDNA FLJ20161 fis, clone COL09252, highly similar to L33930 *Homo sapiens* CD24 signal | 7.4E−202 |
| 4219 | M00055698C:E05 | MA169:E12 | 0.82609 | | | |
| 4220 | M00042347C:D07 | MA181:E12 | | M12759 | gi\|532596\|gb\|M12759.1HUMIGJ02 Human Ig J chain gene, exons 3 and 4 | 3.2E−166 |
| 4221 | M00055702C:C04 | MA169:F12 | 0.85 | | | |
| 4222 | M00042348C:F03 | MA181:G12 | | x60489 | gi\|31099\|emb\|X60489.1HSEF1B Human mRNA for elongation factor-1-beta | 6.68E−233 |
| 4223 | M00055335D:E01 | MA197:D06 | | BC003510 | gi\|13097578\|gb\|BC003510.1BC003510 *Homo sapiens*, prothymosin, alpha (gene sequence 28), clone MGC: 10549 IMAGE: 3610808, mRNA, complet | 2.6E−176 |
| 4224 | M00056180C:E06 | MA180:B06 | | BC018190 | gi\|17390422\|gb\|BC018190.1BC018190 *Homo sapiens*, Similar to metallothionein 1L, clone MGC: 9187 IMAGE: 3859643, mRNA, complete cds | 5.3E−171 |
| 4225 | M00056184B:G11 | MA180:D06 | | Y00345 | gi\|35569\|emb\|Y00345.1HSPOLYAB Human mRNA for polyA binding protein | 8.2E−254 |
| 4226 | M00056514A:F06 | MA173:A12 | | AJ335311 | gi\|15879729\|emb\|AJ335311.1HSA335311 *Homo sapiens* genomic sequence surrounding NotI site, clone NR1-WB8C | 7.7E−54 |
| 4227 | M00056514C:H11 | MA173:D12 | | BC000386 | gi\|12653234\|gb\|BC000386.1BC000386 *Homo sapiens*, eukaryotic translation initiation factor 3, subunit 3 (gamma, 40 kD), clone MGC: 8431 | 1.8E−242 |
| 4228 | M00054674D:C05 | MA187:C06 | | D14530 | gi\|414348\|dbj\|D14530.1HUMRSPT Human homolog of yeast ribosomal protein S28, complete cds | 8.3E−198 |

TABLE 32-continued

| SEQ ID NO | Clone ID | MAClone ID | Mask Prcnt | GBHit | GBDescription | GBScore |
|---|---|---|---|---|---|---|
| 4229 | M00054675A:H07 | MA187:D06 | | X00474 | gi\|35706\|emb\|X00474.1HSPS2 Human pS2 mRNA induced by estrogen from human breast cancer cell line MCF-7 | 7.8E−170 |
| 4230 | M00054878A:G12 | MA189:D06 | | AL359678 | gi\|15215911\|emb\|AL359678.15AL359678 Human DNA sequence from clone RP11-550J21 on chromosome 9, complete sequence [Homo sapiens] | 2.4E−207 |
| 4231 | M00054676B:D07 | MA187:H06 | | BC000749 | gi\|13879207\|gb\|BC000749.1BC000749 Homo sapiens, lactate dehydrogenase A, clone MGC: 2417 IMAGE: 2960999, mRNA, complete cds | 2.9E−129 |
| 4232 | M00054725A:E09 | MA187:B12 | | NM_022551 | gi\|14165467\|ref\|NM_022551.2 Homo sapiens ribosomal protein S18 (RPS18), mRNA | 2.7E−241 |
| 4233 | M00054924C:B09 | MA189:C12 | 0.63711 | | | |
| 4234 | M00054726D:B04 | MA187:D12 | | X16064 | gi\|37495\|emb\|X16064.1HSTUMP Human mRNA for translationally controlled tumor protein | 1.1E−271 |
| 4235 | M00054927A:H09 | MA189:E12 | | X06705 | gi\|35511\|emb\|X06705.1HSPLAX Human PLA-X mRNA | 2.7E−297 |
| 4236 | M00054727C:F11 | MA187:F12 | 0.7234 | | | |
| 4237 | M00054728A:H05 | MA187:H12 | | X16064 | gi\|37495\|emb\|X16064.1HSTUMP Human mRNA for translationally controlled tumor protein | 1.3E−168 |
| 4238 | M00054930B:G05 | MA189:H12 | | U15008 | gi\|600747\|gb\|U15008.1HSU15008 Human SnRNP core protein Sm D2 mRNA, complete cds | 7E−270 |
| 4239 | M00057214C:G11 | MA193:B06 | | U55206 | gi\|2957143\|gb\|U55206.1HSU55206 Homo sapiens human gamma-glutamyl hydrolase (hGH) mRNA, complete cds | 4.1E−115 |
| 4240 | M00057216C:G01 | MA193:D06 | | BC000695 | gi\|12653812\|gb\|BC000695.1BC000695 Homo sapiens, Similar to tetraspan 1, clone IMAGE: 3349380, mRNA | 7.3E−28 |
| 4241 | M00057217C:B07 | MA193:F06 | | AK057120 | gi\|16552707\|dbj\|AK057120.1AK057120 Homo sapiens cDNA FLJ32558 fis, clone SPLEN1000143, highly similar to HIGH MOBILITY GROUP PROTEL | 3.6E−206 |
| 4242 | M00042695A:H04 | MA167:B06 | | BC007075 | gi\|13937928\|gb\|BC007075.1BC007075 Homo sapiens, hemoglobin, beta, clone MGC: 14540 IMAGE: 4292125, mRNA, complete cds | 9.6E−37 |
| 4243 | M00042695D:D09 | MA167:C06 | | BC018749 | gi\|17511797\|gb\|BC018749.1BC018749 Homo sapiens, Similar to immunoglobulin lambda joining 3, clone MGC: 31942 IMAGE: 4854511, mRNA, co | 3.5E−194 |
| 4244 | M00042771A:D01 | MA171:D06 | | BC007659 | gi\|4043327\|gb\|BC007659.1BC007659 Homo sapiens, diaphorase (NADH/NADPH) (cytochrome b-5 reductase), clone MGC: 2073 IMAGE: 3349257, m | 6.7E−239 |
| 4245 | M00042772D:F02 | MA171:E06 | | NM_002295 | gi\|9845501\|ref\|NM_002295.2 Homo sapiens laminin receptor 1 (67 kD, ribosomal protein SA) (LAMR1), mRNA | 2.2E−254 |
| 4246 | M00042773A:A12 | MA171:F06 | | AK000009 | gi\|7019813\|dbj\|AK000009.1AK000009 Homo sapiens cDNA FLJ20002 fis, clone ADKA01577 | 2.6E−213 |
| 4247 | M00042699B:B10 | MA167:G06 | | X98311 | gi\|1524059\|emb\|X98311.1HSCGM2ANT H. sapiens mRNA for carcinoembryonic antigen family member 2, CGM2 | 1.5E−31 |
| 4248 | M00042889A:H07 | MA167:A12 | | NM_005950 | gi\|10835229\|ref\|NM_005950.1 Homo sapiens metallothionein 1G (MT1G), mRNA | 6E−202 |
| 4249 | M00042819A:C09 | MA171:A12 | | BC009220 | gi\|14327996\|gb\|BC009220.1BC009220 Homo sapiens, clone MGC: 16362 IMAGE: 3927795, mRNA, complete cds | 5.2E−218 |
| 4250 | M00042819C:B03 | MA171:B12 | | NM_000995 | gi\|16117786\|ref\|NM_000995.2 Homo sapiens ribosomal protein L34 (RPL34), transcript variant 1, mRNA | 9.4E−207 |
| 4251 | M00042895B:C02 | MA167:C12 | | AF217186 | gi\|11526786\|gb\|AF217186.1AF217186 Homo sapiens inorganic pyrophosphatase 1 (PPA1) mRNA, complete cds | 1.4E−283 |
| 4252 | M00042823B:A02 | MA171:C12 | | A1F212248 | gi\|13182770\|gb\|AF212248.1AF212248 Homo sapiens CDA09 mRNA, complete cds | 5.1E−252 |

TABLE 32-continued

| SEQ ID NO | Clone ID | MAClone ID | Mask Prcnt | GBHit | GBDescription | GBScore |
|---|---|---|---|---|---|---|
| 4253 | M00042895D:B04 | MA167:E12 | | U83908 | gi|1825561|gb|U83908.1HSU83908 Human nuclear antigen H731 mRNA, complete cds | 2.4E−229 |
| 4254 | M00056564B:F11 | MA174:F06 | | AL136593 | gi|7018431|emb|AL136593.1HSM801567 Homo sapiens mRNA; cDNA DKFZp761K102 (from clone DKFZp761K102); complete cds | 3.4E−284 |
| 4255 | M00056564C:E08 | MA174:G06 | | Z74616 | gi|1418929|emb|Z74616.1HSPPA2ICO H. sapiens mRNA for prepro-alpha2(I) collagen | 1.4E−286 |
| 4256 | M00056615D:A01 | MA174:A12 | | X12881 | gi|34036|emb|X12881.1HSKER18R Human mRNA for cytokeratin 18 | 1.8E−273 |
| 4257 | M00056620D:F02 | MA174:G12 | | AK000335 | gi|7020350|dbj|AK000335.1AK000335 Homo sapiens cDNA FLJ20328 fis, clone HEP10039 | 3.5E−287 |
| 4258 | RG:359184:10009:A06 | MA158:A06 | | M35663 | gi|189505|gb|M35663.1HUMP68A Human p68 kinase mRNA, complete cds | 1.6E−258 |
| 4259 | RG:428530:10009:D12 | MA158:D12 | | AF321918 | gi|12958659|gb|AF321918.1AF321918 Homo sapiens testicular acid phosphatase (ACPT) gene, complete cds, alternatively spliced product | 0 |
| 4260 | M00057310A:A07 | MA182:A06 | | AF054187 | gi|4092059|gb|AF054187.1AF054187 Homo sapiens alpha NAC mRNA, complete cds | 7.3E−143 |
| 4261 | M00054503C:H10 | MA184:F06 | | BC018828 | gi|17402971|gb|BC018828.1BC018828 Homo sapiens, clone IMAGE: 3343539, mRNA | 2E−276 |
| 4262 | M00043302C:D03 | MA182:C12 | | BC006791 | gi|13905015|gb|BC006791.1BC006791 Homo sapiens, ribosomal protein L10a, clone MGC: 5203 IMAGE: 2901249, mRNA, complete cds | 8.3E−282 |
| 4263 | M00054535B:F10 | MA184:F12 | | S35960 | gi|249370|gb|S35960.1S35960 laminin receptor homolog {3' region} [human, mRNA Partial, 739 nt] | 4.1E−112 |
| 4264 | M00054535C:D10 | MA184:G12 | | BC008063 | gi|14165520|gb|BC008063.1BC008063 Homo sapiens, Similar to KIAA0102 gene product, clone MGC: 2249 IMAGE: 2967488, mRNA, complete cds | 4.7E−274 |
| 4265 | M00054535C:H09 | MA184:H12 | | AB020680 | gi|4240234|dbj|AB020680.1AB020680 Homo sapiens mRNA for KIAA0873 protein, partial cds | 3.1E−275 |
| 4266 | M00054964B:A08 | MA198:C06 | | BC017189 | gi|16877928|gb|BC017189.1BC017189 Homo sapiens, myo-iositol 1-phosphate synthase A1, clone MGC: 726 IMAGE: 3140452, mRNA, complete c | 1.1E−190 |
| 4267 | M00054966C:H01 | MA198:D06 | | BC018828 | gi|17402971|gb|BC018828.1BC018828 Homo sapiens, clone IMAGE: 3343539, mRNA | 4.4E−190 |
| 4268 | M00055022D:F01 | MA198:D12 | | NM_000975 | gi|15431289|ref|NM_000975.2 Homo sapiens ribosomal protein L11 (RPL11), mRNA | 2.5E−182 |
| 4269 | M00055026C:C12 | MA198:G12 | | NM_007209 | gi|16117792|ref|NM_007209.2 Homo sapiens ribosomal protein L35 (RPL35), mRNA | 4E−184 |
| 4270 | M00055027B:C11 | MA198:H12 | | AF283772 | gi|10281741|gb|AF283772.2AF283772 Homo sapiens clone TCBAP0781 mRNA sequence | 1E−187 |
| 4271 | M00055826D:C11 | MA170:E12 | 0.7443 | | | |
| 4272 | M00055828C:D10 | MA170:G12 | | V00662 | gi|13003|emb|V00662.1MIHSXX H. sapiens mitochondrial genome | 9.5E−229 |
| 4273 | M00055828D:F12 | MA170:H12 | 0.71968 | BC001573 | gi|16306770|gb|BC001573.1BC001573 Homo sapiens, clone MGC: 5522 IMAGE: 3454199, mRNA, complete cds | 2.8E−37 |
| 4274 | M00055215C:E11 | MA196:B06 | | BC001118 | gi|12654566|gb|BC001118.1BC001118 Homo sapiens, Similar to seven transmembrane domain protein, clone MGC: 1936 IMAGE: 2989840, mRNA, | 2.4E−288 |
| 4275 | M00055217C:E09 | MA196:D06 | | BC010187 | gi|14603477|gb|BC010187.1BC010187 Homo sapiens, ribosomal protein S11, clone MGC: 20218 IMAGE: 4547934, mRNA, complete cds | 4.3E−215 |
| 4276 | M00055221B:C01 | MA196:E06 | | NM_001016 | gi|14277699|ref|NM_001016.2 Homo sapiens ribosomal protein S12 (RPS12), mRNA | 4.7E−246 |

TABLE 32-continued

| SEQ ID NO | Clone ID | MAClone ID | Mask Prcnt | GBHit | GBDescription | GBScore |
|---|---|---|---|---|---|---|
| 4277 | M00055222A:E02 | MA196:G06 | | NM_000987 | gi\|17017970\|ref\|NM_000987.2 *Homo sapiens* ribosomal protein L26 (RPL26), mRNA | 2.1E−226 |
| 4278 | M00056226D:F03 | MA180:B12 | | BC011835 | gi\|15080118\|gb\|BC011835.1\|BC011835 *Homo sapiens*, Similar to ATPase, Na+/K+ transporting, beta 3 polypeptide, clone MGC: 20152 IMAGE: 3 | 1.7E−57 |
| 4279 | M00055258A:G02 | MA196:F12 | | BC016753 | gi\|16876954\|gb\|BC016753.1\|BC016753 *Homo sapiens*, clone MGC: 1138 IMAGE: 2987963, mRNA, complete cds | 1.3E−102 |
| 4280 | M00055998A:A02 | MA179:A06 | | AF343729 | gi\|13649973\|gb\|AF343729.1\|AF343729 *Homo sapiens* 3-alpha hydroxysteroid dehydrogenase mRNA, complete cds | 1.4E−283 |
| 4281 | M00056945A:B11 | MA177:A06 | 0.89778 | | | |
| 4282 | M00056945D:H03 | MA177:C06 | 0.71282 | | | |
| 4283 | M00056001A:F11 | MA179:D06 | | BC015983 | gi\|16359036\|gb\|BC015983.1\|BC015983 *Homo sapiens*, clone IMAGE: 4074053, mRNA | 4.5E−165 |
| 4284 | M00056946D:B04 | MA177:F06 | | AF028832 | gi\|3287488\|gb\|AF028832.1\|AF028832 *Homo sapiens* Hsp89-alpha-delta-N mRNA, complete cds | 1E−296 |
| 4285 | M00056101B:B02 | MA179:A12 | | AL049999 | gi\|4884252\|emb\|AL049999.1\|HSM800347 *Homo sapiens* mRNA; cDNA DKFZp564M182 (from clone DKFZp564M182); partial cds | 3E−100 |
| 4286 | M00056110C:D09 | MA179:E12 | | AK024903 | gi\|10437317\|dbj\|AK024903.1\|AK024903 *Homo sapiens* cDNA: FLJ21250 fis, clone COL01253, highly similar to AB020527 *Homo sapiens* mRNA fo | 1E−209 |
| 4287 | M00056111B:H03 | MA179:F12 | 0.81436 | | | |
| 4288 | M00054772B:H06 | MA188:G06 | | L19185 | gi\|440307\|gb\|L19185.1\|HUMNKEFB Human natural killer cell enhancing factor (NKEFB) mRNA, complete cds | 3.6E−178 |
| 4289 | M00054825B:B05 | MA188:C12 | 0.09038 | NM_005348 | gi\|13129149\|ref\|NM_005348.1 *Homo sapiens* heat shock 90 kD protein 1, alpha (HSPCA), mRNA | 4.1E−222 |
| 4290 | M00054831A:G04 | MA188:D12 | | AL359585 | gi\|8655645\|emb\|AL359585.1\|HSM802687 *Homo sapiens* mRNA; cDNA DKFZp762B195 (from clone DKFZp762B195) | 6.2E−116 |
| 4291 | M00054831D:B07 | MA188:F12 | | U43701 | gi\|1399085\|gb\|U43701.1\|HSU43701 Human ribosomal protein L23a mRNA, complete cds | 4.2E−296 |
| 4292 | M00042862D:A12 | MA172:B06 | | BC007097 | gi\|13937968\|gb\|BC007097.1\|BC007097 *Homo sapiens*, tissue inhibitor of metalloproteinase 1 (erythroid potentiating activity, collagena | 1.9E−248 |
| 4293 | M00042864A:E05 | MA172:E06 | 0.59184 | | | |
| 4294 | M00042864D:E06 | MA172:F06 | | NM_007099 | gi\|6005987\|ref\|NM_007099.1 *Homo sapiens* acid phosphatase 1, soluble (ACP1), transcript variant b, mRNA | 3.5E−228 |
| 4295 | M00055514B:A05 | MA168:E12 | | BC001190 | gi\|12654700\|gb\|BC001190.1\|BC001190 *Homo sapiens*, Similar to creatine kinase, brain, clone MGC: 3160 IMAGE: 3354679, mRNA, complete cds | 1.4E−230 |
| 4296 | M00056763B:A12 | MA175:D06 | | NM_004417 | gi\|7108342\|ref\|NM_004417.2 *Homo sapiens* dual specificity phosphatase 1 (DUSP1), mRNA | 6.4E−267 |
| 4297 | M00056767D:F06 | MA175:F06 | | AF203815 | gi\|6979641\|gb\|AF203815.1\|AF203815 *Homo sapiens* alpha gene sequence | 8.6E−285 |
| 4298 | M00056821A:D08 | MA175:A12 | | NM_001016 | gi\|14277699\|ref\|NM_001016.2 *Homo sapiens* ribosomal protein S12 (RPS12), mRNA | 8.3E−220 |
| 4299 | M00056822C:G03 | MA175:C12 | | NM_000970 | gi\|16753226\|ref\|NM_000970.2 *Homo sapiens* ribosomal protein L6 (RPL6), mRNA | 3.4E−284 |
| 4300 | M00056823D:H02 | MA175:E12 | | BC018828 | gi\|17402971\|gb\|BC018828.1\|BC018828 *Homo sapiens*, clone IMAGE: 3343539, mRNA | 1.9E−276 |
| 4301 | RG:1609994:10014:A06 | MA163:A06 | | BC006322 | gi\|13623444\|gb\|BC006322.1\|BC006322 *Homo sapiens*, activating transcription factor 3, clone MGC: 12746 IMAGE: 4138076, mRNA, complete cd | 1E−300 |

TABLE 32-continued

| SEQ ID NO | Clone ID | MAClone ID | Mask Prcnt | GBHit | GBDescription | GBScore |
|---|---|---|---|---|---|---|
| 4302 | RG:1667183:10014:F12 | MA163:F12 | | BC000013 | gi|12652546|gb|BC000013.1BC000013 *Homo sapiens*, insulin-like growth factor binding protein 3, clone MGC: 2305 IMAGE: 3506666, mRNA, c | 5.4E−58 |
| 4303 | M00043358D:C06 | MA183:A06 | | AF113008 | gi|6642739|gb|AF113008.1AF113008 *Homo sapiens* clone FLB0708 mRNA sequence | 1.5E−152 |
| 4304 | M00054558B:E05 | MA185:A06 | 0.69811 | BC014498 | gi|15680272|gb|BC014498.1BC014498 *Homo sapiens*, clone IMAGE: 4856273, mRNA | 1.1E−27 |
| 4305 | M00043361B:G03 | MA183:E06 | | NM_001025 | gi|14790142|ref|NM_001025.2 *Homo sapiens* ribosomal protein S23 (RPS23), mRNA | 1.3E−218 |
| 4306 | M00043408C:D11 | MA183:G12 | | U14967 | gi|550014|gb|U14967.1HSU14967 Human ribosomal protein L21 mRNA, complete cds | 1.4E−283 |
| 4307 | M00054632A:E11 | MA185:H12 | 0.18764 | X73459 | gi|313660|emb|X73459.1HSSRP14A *H. sapiens* mRNA for signal recognition particle subunit 14 | 2E−140 |
| 4308 | M00056661A:G05 | MA186:A06 | | L18960 | gi|306724|gb|L18960.1HUMEIF4C Human protein synthesis factor (eIF-4C) mRNA, complete cds | 5.2E−280 |
| 4309 | M00056661C:C11 | MA186:B06 | | S72481 | gi|632789|gb|S72481.1S72481 pantophysin [human, keratinocyte line HaCaT, mRNA, 2106 nt] | 3.4E−281 |
| 4310 | M00055412D:E05 | MA199:B06 | | M26697 | gi|189311|gb|M26697.1HUMNUMB23 Human nucleolar protein (B23) mRNA, complete cds | 8.9E−176 |
| 4311 | M00055413A:G12 | MA199:C06 | | BC012354 | gi|15214456|gb|BC012354.1BC012354 *Homo sapiens*, clone MGC: 20390 IMAGE: 4564801, mRNA, complete cds | 1.9E−95 |
| 4312 | M00055414D:A09 | MA199:D06 | | X06705 | gi|35511|emb|X06705.1HSPLAX Human PLA-X mRNA | 4.1E−187 |
| 4313 | M00056707B:C01 | MA186:C12 | | AF178581 | gi|10800410|gb|AF178581.2AF178581 *Homo sapiens* nasopharyngeal carcinoma gene sequence | 1.3E−252 |
| 4314 | M00056237D:C10 | MA181:D01 | 0.64821 | | | |
| 4315 | M00056238B:D03 | MA181:E01 | | AF083241 | gi|5106776|gb|AF083241.1HSPC024 *Homo sapiens* HSPC024 mRNA, complete cds | 9.4E−257 |
| 4316 | M00056239B:D05 | MA181:G01 | 0.89873 | | | |
| 4317 | M00056241B:H07 | MA181:H01 | 0.625 | NM_033340 | gi|1571870|ref|NM_033340.1 *Homo sapiens* caspase 7, apoptosis-related cysteine protease (CASP7), transcript variant beta, mRNA | 2.2E−50 |
| 4318 | I:2921194:04B02:C06 | MA118:C06 | | AB006780 | gi|2385451|dbj|AB006780.1AB006780 *Homo sapiens* mRNA for galectin-3, complete cds | 3.1E−222 |
| 4319 | I:1624865:04B02:G06 | MA118:G06 | | U15009 | gi|600749|gb|U15009.1HSU15009 Human SnRNP core protein Sm D3 mRNA, complete cds | 4.7E−246 |
| 4320 | I:1728607:04A02:H06 | MA116:H06 | | BC016164 | gi|16740573|gb|BC016164.1BC016164 *Homo sapiens*, small inducible cytokine subfamily D (Cys-X3-Cys), member 1 (fractalkine, neurotact | 1E−262 |
| 4321 | I:2827453:04B02:H06 | MA118:H06 | | U27143 | gi|862932|gb|U27143.1HSU27143 Human protein kinase C inhibitor-I cDNA, complete cds | 2.5E−113 |
| 4322 | I:2070593:04B02:D12 | MA118:D12 | | D83004 | gi|1181557|dbj|D83004.1D83004 Human epidennoid carcinoma mRNA for ubiquitin-conjugating enzyme E2 similar to *Drosophila* bendless ge | 1.5E−233 |
| 4323 | I:2683114:04A02:H12 | MA116:H12 | | L20493 | gi|306754|gb|L20493.1HUMGAGLUTD Human gamma-glutamyl transpeptidase mRNA, complete cds | 1E−300 |
| 4324 | I:1809336:02A02:G06 | MA108:G06 | | U09117 | gi|483919|gb|U09117.1HSU09117 Human phospholipase c delta 1 mRNA, complete cds | 1.3E−280 |

Example 50

Detection of Differential Expression Using Arrays cDNA probes were prepared from total RNA isolated from the patient cells described above. Since LCM provides for the isolation of specific cell types to provide a substantially homogenous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) *Nature Med* 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from normal cell RNA sample. For example, the cDNA probes from the normal cells were labeled with Cy3 fluorescent dye (green) and the cDNA probes prepared from the tumor cells were labeled with Cy5 fluorescent dye (red), and vice versa.

Each array used had an identical spatial layout and control spot set. Each microarray was divided into two areas, each area having an array with, on each half, twelve groupings of 32×12 spots, for a total of about 9,216 spots on each array. The two areas are spotted identically which provide for at least two duplicates of each clone per array.

Polynucleotides for use on the arrays were obtained from both publicly available sources and from cDNA libraries generated from selected cell lines and patient tissues as described above and in Table 31. PCR products of from about 0.5 kb to 2.0 kb amplified from these sources were spotted onto the array using a Molecular Dynamics Gen III spotter according to the manufacturer's recommendations. The first row of each of the 24 regions on the array had about 32 control spots, including 4 negative control spots and 8 test polynucleotides. The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about four duplicate measurements for each clone, two of one color and two of the other, for each sample.

The differential expression assay was performed by mixing equal amounts of probes from tumor cells and normal cells of the same patient. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p>10^{-3}$, and the differential ratio was set to 1.000 for those spots. All other spots have a significant difference in expression between the tumor and normal sample. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level (p>0.05).

Table 33 provides the results for gene products that were expressed by at least 2-fold or greater in the colon tumor samples relative to normal tissue samples in at least 20% of the patients tested, or gene products in which expression levels of the gene in colon tumor cells was less than or equal to ½ of the expression level in normal tissue samples in at least 20% of the patients tested. Table 33 includes: (1) the "SEQ ID NO" of the sequence tested; (2) the spot identification number ("Spot ID"); (3) the "Clone ID" assigned to the clone from which the sequence was isolated; (4) the "MAClone ID" assigned to the clone from which the sequence was isolated; (5) the percentage of patients tested in which expression levels (e.g., as message level) of the gene was at least 2-fold greater in cancerous tissue than in matched normal tissue (">=2×"); (6) the percentage of patients tested in which expression levels (e.g., as message level) of the gene was at least 5-fold greater in cancerous tissue than in matched normal tissue (">=5×"); (7) the percentage of patients tested in which expression levels (e.g., as message level) of the gene was less than or equal to ½ of the expression level in matched normal cells ("<=halfx"); and (8) the number of patients analyzed ("Num Ratios").

Table 33 also includes the results from each patient, identified by the patient ID number (e.g., 10). This data represents the ratio of differential expression for the samples tested from that particular patient's tissues (e.g., "10" is the ratio from the tissue samples of Patient ID no. 10). The ratios of differential expression are expressed as a normalized hybridization signal associated with the tumor probe divided by the normalized hybridization signal with the normal probe. Thus, a ratio greater than 1 indicates that the gene product is increased in expression in cancerous cells relative to normal cells, while a ratio of less than 1 indicates the opposite.

These data provide evidence that the genes represented by the polynucleotides having the indicated sequences are differentially expressed in colon cancer as compared to normal non-cancerous colon tissue.

Example 51

Antisense Regulation of Gene Expression

The expression of the differentially expressed genes represented by the polynucleotides in the cancerous cells can be analyzed using antisense knockout technology to confirm the role and function of the gene product in tumorigenesis, e.g., in promoting a metastatic phenotype.

A number of different oligonucleotides complementary to the mRNA generated by the differentially expressed genes identified herein can be designed as potential antisense oligonucleotides, and tested for their ability to suppress expression of the genes. Sets of antisense oligomers specific to each candidate target are designed using the sequences of the polynucleotides corresponding to a differentially expressed gene and the software program HYBsimulator Version 4 (available for Windows 95/Windows NT or for Power Macintosh, RNAture, Inc. 1003 Health Sciences Road, West, Irvine, Calif. 92612 USA). Factors that are considered when designing antisense oligonucleotides include: 1) the secondary structure of oligonucleotides; 2) the secondary structure of the target gene; 3) the specificity with no or minimum cross-hybridization to other expressed genes; 4) stability; 5) length and 6) terminal GC content. The antisense oligonucleotide is designed so that it will hybridize to its target sequence under conditions of high stringency at physiological temperatures (e.g., an optimal temperature for the cells in culture to provide for hybridization in the cell, e.g., about 37° C.), but with minimal formation of homodimers.

Using the sets of oligomers and the HYBsimulator program, three to ten antisense oligonucleotides and their reverse controls are designed and synthesized for each candidate mRNA transcript, which transcript is obtained from the gene corresponding to the target polynucleotide sequence of interest. Once synthesized and quantitated, the oligomers are screened for efficiency of a transcript knock-out in a panel of cancer cell lines. The efficiency of the knock-out is determined by analyzing mRNA levels using lightcycler quantification. The oligomers that resulted in the highest level of transcript knock-out, wherein the level was at least about 50%, preferably about 80-90%, up to 95% or more up to undetectable message, are selected for use in a cell-based proliferation assay, an anchorage independent growth assay, and an apoptosis assay.

The ability of each designed antisense oligonucleotide to inhibit gene expression is tested through transfection into SW620 colon carcinoma cells. For each transfection mixture, a carrier molecule (such as a lipid, lipid derivative, lipid-like molecule, cholesterol, cholesterol derivative, or cholesterol-like molecule) is prepared to a working concentration of 0.5 mM in water, sonicated to yield a uniform solution, and filtered through a 0.45 µm PVDF membrane. The antisense or control oligonucleotide is then prepared to a working concentration of 100 µM in sterile Millipore water. The oligonucleotide is further diluted in OptiMEM™ (Gibco/BRL), in a microfuge tube, to 2 µM, or approximately 20 µg oligo/ml of OptiMEM™. In a separate microfuge tube, the carrier molecule, typically in the amount of about 1.5-2 nmol carrier/µg antisense oligonucleotide, is diluted into the same volume of OptiMEM™ used to dilute the oligonucleotide. The diluted antisense oligonucleotide is immediately added to the diluted carrier and mixed by pipetting up and down. Oligonucleotide is added to the cells to a final concentration of 30 nM.

The level of target mRNA that corresponds to a target gene of interest in the transfected cells is quantitated in the cancer cell lines using the Roche LightCycler™ real-time PCR machine. Values for the target mRNA are normalized versus an internal control (e.g., beta-actin). For each 20 µl reaction, extracted RNA (generally 0.2-1 µg total) is placed into a sterile 0.5 or 1.5 ml microcentrifuge tube, and water is added to a total volume of 12.5 µl. To each tube is added 7.5 µl of a buffer/enzyme mixture, prepared by mixing (in the order listed) 2.5 µl $H_2O$, 2.0 µl 10× reaction buffer, 10 µl oligo dT (20 pmol), 1.0 µl dNTP mix (10 mM each), 0.5 µl RNAsin® (20 u) (Ambion, Inc., Hialeah, Fla.), and 0.5 µl MMLV reverse transcriptase (50 u) (Ambion, Inc.). The contents are mixed by pipetting up and down, and the reaction mixture is incubated at 42° C. for 1 hour. The contents of each tube are centrifuged prior to amplification.

An amplification mixture is prepared by mixing in the following order: 1× PCR buffer II, 3 mM $MgCl_2$, 140 µM each dNTP, 0.175 pmol each oligo, 1:50,000 dil of SYBR® Green, 0.25 mg/ml BSA, 1 unit Taq polymerase, and $H_2O$ to 20 µl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 µl aliquot of amplification mixture, 2 µl of template RT is added, and amplification is carried out according to standard protocols. The results are expressed as the percent decrease in expression of the corresponding gene product relative to non-transfected cells, vehicle-only transfected (mock-transfected) cells, or cells transfected with reverse control oligonucleotides.

Example 52

Effect of Expression on Proliferation

The effect of gene expression on the inhibition of cell proliferation can be assessed in metastatic breast cancer cell lines (MDA-MB-231 ("231")); SW620 colon colorectal carcinoma cells; SKOV3 cells (a human ovarian carcinoma cell line); or LNCaP, PC3, 22Rv1, MDA-PCA-2b, or DU145 prostate cancer cells.

Cells are plated to approximately 60-80% confluency in 96-well dishes. Antisense or reverse control oligonucleotide is diluted to 2 µM in OptiMEM™. The oligonucleotide-OptiMEM™ can then be added to a delivery vehicle, which delivery vehicle can be selected so as to be optimized for the particular cell type to be used in the assay. The oligo/delivery vehicle mixture is then further diluted into medium with serum on the cells. The final concentration of oligonucleotide for all experiments can be about 300 nM.

Antisense oligonucleotides are prepared as described above (see Example 51). Cells are transfected overnight at 37° C. and the transfection mixture is replaced with fresh medium the next morning. Transfection is carried out as described above in Example 51.

Those antisense oligonucleotides that result in inhibition of proliferation of SW620 cells indicate that the corresponding gene plays a role in production or maintenance of the cancerous phenotype in cancerous colon cells. Those antisense oligonucleotides that inhibit proliferation in SKOV3 cells represent genes that play a role in production or maintenance of the cancerous phenotype in cancerous breast cells. Those antisense oligonucleotides that result in inhibition of proliferation of MDA-MB-231 cells indicate that the corresponding gene plays a role in production or maintenance of the cancerous phenotype in cancerous ovarian cells. Those antisense oligonucleotides that inhibit proliferation in LNCaP, PC3, 22Rv1, MDA-PCA-2b, or DU145 cells represent genes that play a role in production or maintenance of the cancerous phenotype in cancerous prostate cells.

Example 53

Effect of Gene Expression on Cell Migration

The effect of gene expression on the inhibition of cell migration can be assessed in SW620 colon cancer cells using static endothelial cell binding assays, non-static endothelial cell binding assays, and transmigration assays.

For the static endothelial cell binding assay, antisense oligonucleotides are prepared as described above (see Example 51). Two days prior to use, colon cancer cells (CaP) are plated and transfected with antisense oligonucleotide as described above (see Examples 51 and 52). On the day before use, the medium is replaced with fresh medium, and on the day of use, the medium is replaced with fresh medium containing 2 μM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in DMEM/1% BSA/10 mM HEPES pH 7.0. Finally, CaP cells are counted and resuspended at a concentration of $1 \times 10^6$ cells/ml.

Endothelial cells (EC) are plated onto 96-well plates at 40-50% confluence 3 days prior to use. On the day of use, EC are washed 1× with PBS and 506 DMDM/1% BSA/10 mM HEPES pH 7 is added to each well. To each well is then added 50K (50λ) CaP cells in DMEM/1% BSA/10 mM HEPES pH 7. The plates are incubated for an additional 30 min and washed 5× with PBS containing $Ca^{++}$ and $Mg^{++}$. After the final wash, 100 μL PBS is added to each well and fluorescence is read on a fluorescent plate reader (Ab492/Em 516 nm).

For the non-static endothelial cell binding assay, CaP are prepared as described above. EC are plated onto 24-well plates at 30-40% confluence 3 days prior to use. On the day of use, a subset of EC are treated with cytokine for 6 hours then washed 2× with PBS. To each well is then added 150-200K CaP cells in DMEM/1% BSA/10 mM HEPES pH 7. Plates are placed on a rotating shaker (70 RPM) for 30 min and then washed 3× with PBS containing $Ca^{++}$ and $Mg^{++}$. After the final wash, 500 μL PBS is added to each well and fluorescence is read on a fluorescent plate reader (Ab492/Em 516 nm).

For the transmigration assay, CaP are prepared as described above with the following changes. On the day of use, CaP medium is replaced with fresh medium containing 5 μM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in EGM-2-MV medium. Finally, CaP cells are counted and resuspended at a concentration of $1 \times 10^6$ cells/ml.

EC are plated onto FluorBlok transwells (BD Biosciences) at 30-40% confluence 5-7 days before use. Medium is replaced with fresh medium 3 days before use and on the day of use. To each transwell is then added 50K labeled CaP. 30 min prior to the first fluorescence reading, 10 μg of FITC-dextran (10K MW) is added to the EC plated filter. Fluorescence is then read at multiple time points on a fluorescent plate reader (Ab492/Em 516 nm).

Those antisense oligonucleotides that result in inhibition of binding of SW620 colon cancer cells to endothelial cells indicate that the corresponding gene plays a role in the production or maintenance of the cancerous phenotype in cancerous colon cells. Those antisense oligonucleotides that result in inhibition of endothelial cell transmigration by SW620 colon cancer cells indicate that the corresponding gene plays a role in the production or maintenance of the cancerous phenotype in cancerous colon cells.

Example 54

Effect of Gene Expression on Colony Formation

The effect of gene expression upon colony formation of SW620 cells, SKOV3 cells, MD-MBA-231 cells, LNCaP cells, PC3 cells, 22Rv1 cells, MDA-PCA-2b cells, and DU145 cells can be tested in a soft agar assay. Soft agar assays are conducted by first establishing a bottom layer of 2 ml of 0.6% agar in media plated fresh within a few hours of layering on the cells. The cell layer is formed on the bottom layer by removing cells transfected as described above from plates using 0.05% trypsin and washing twice in media. The cells are counted in a Coulter counter, and resuspended to $10^6$ per ml in media. 10 μl aliquots are placed with media in 96-well plates (to check counting with WST1), or diluted further for the soft agar assay. 2000 cells are plated in 800 μl 0.4% agar in duplicate wells above 0.6% agar bottom layer. After the cell layer agar solidifies, 2 ml of media is dribbled on top and antisense or reverse control oligo (produced as described in Example 51) is added without delivery vehicles. Fresh media and oligos are added every 3-4 days. Colonies form in 10 days to 3 weeks. Fields of colonies are counted by eye. Wst-1 metabolism values can be used to compensate for small differences in starting cell number. Larger fields can be scanned for visual record of differences.

Those antisense oligonucleotides that result in inhibition of colony formation of SW620 cells indicate that the corresponding gene plays a role in production or maintenance of the cancerous phenotype in cancerous colon cells. Those antisense oligonucleotides that inhibit colony formation in SKOV3 cells represent genes that play a role in production or maintenance of the cancerous phenotype in cancerous breast cells. Those antisense oligonucleotides that result in inhibition of colony formation of MDA-MB-231 cells indicate that the corresponding gene plays a role in production or maintenance of the cancerous phenotype in cancerous ovarian cells. Those antisense oligonucleotides that inhibit colony formation in LNCaP, PC3, 22Rv1, MDA-PCA-2b, or DU145 cells represent genes that play a role in production or maintenance of the cancerous phenotype in cancerous prostate cells.

Example 55

Induction of Cell Death Upon Depletion of Polypeptides by Depletion of mRNA ("Antisense Knockout")

In order to assess the effect of depletion of a target message upon cell death, SW620 cells, or other cells derived from a cancer of interest, can be transfected for proliferation assays. For cytotoxic effect in the presence of cisplatin (cis), the same protocol is followed but cells are left in the presence of 2 µM drug. Each day, cytotoxicity is monitored by measuring the amount of LDH enzyme released in the medium due to membrane damage. The activity of LDH is measured using the Cytotoxicity Detection Kit from Roche Molecular Biochemicals. The data is provided as a ratio of LDH released in the medium vs. the total LDH present in the well at the same time point and treatment (rLDH/tLDH). A positive control using antisense and reverse control oligonucleotides for BCL2 (a known anti-apoptotic gene) is included; loss of message for BCL2 leads to an increase in cell death compared with treatment with the control oligonucleotide (background cytotoxicity due to transfection).

Example 56

Functional Analysis of Gene Products Differentially Expressed in Colon Cancer in Patients The gene products of sequences of a gene differentially expressed in cancerous cells can be further analyzed to confirm the role and function of the gene product in tumorigenesis, e.g., in promoting or inhibiting development of a metastatic phenotype. For example, the function of gene products corresponding to genes identified herein can be assessed by blocking function of the gene products in the cell. For example, where the gene product is secreted or associated with a cell surface membrane, blocking antibodies can be generated and added to cells to examine the effect upon the cell phenotype in the context of, for example, the transformation of the cell to a cancerous, particularly a metastatic, phenotype. In order to generate antibodies, a clone corresponding to a selected gene product is selected, and a sequence that represents a partial or complete coding sequence is obtained. The resulting clone is expressed, the polypeptide produced isolated, and antibodies generated. The antibodies are then combined with cells and the effect upon tumorigenesis assessed.

Where the gene product of the differentially expressed genes identified herein exhibits sequence homology to a protein of known function (e.g., to a specific kinase or protease) and/or to a protein family of known function (e.g., contains a domain or other consensus sequence present in a protease family or in a kinase family), then the role of the gene product in tumorigenesis, as well as the activity of the gene product, can be examined using small molecules that inhibit or enhance function of the corresponding protein or protein family.

Additional functional assays include, but are not necessarily limited to, those that analyze the effect of expression of the corresponding gene upon cell cycle and cell migration. Methods for performing such assays are well known in the art.

Example 57

Contig Assembly and Addition Gene Characterization

The sequences of the polynucleotides provided in the present invention can be used to extend the sequence information of the gene to which the polynucleotides correspond (e.g., a gene, or mRNA encoded by the gene, having a sequence of the polynucleotide described herein). This expanded sequence information can in turn be used to further characterize the corresponding gene, which in turn provides additional information about the nature of the gene product (e.g., the normal function of the gene product). The additional information can serve to provide additional evidence of the gene product's use as a therapeutic target, and provide further guidance as to the types of agents that can modulate its activity.

In one example, a contig is assembled using a sequence of a polynucleotide of the present invention, which is present in a clone. A "contig" is a contiguous sequence of nucleotides that is assembled from nucleic acid sequences having overlapping (e.g., shared or substantially similar) sequence information. The sequences of publicly-available ESTs (Expressed Sequence Tags) and the sequences of various clones from several cDNA libraries synthesized at Chiron can be used in the contig assembly.

The contig is assembled using the software program Sequencher, version 4.05, according to the manufacturer's instructions and an overview alignment of the contiged sequences is produced. The sequence information obtained in the contig assembly can then be used to obtain a consensus sequence derived from the contig using the Sequencher program. The consensus sequence is used as a query sequence in a TeraBLASTN search of the DGTI DoubleTwist Gene Index (DoubleTwist, Inc., Oakland, Calif.), which contains all the EST and non-redundant sequence in public databases.

Through contig assembly and the use of homology searching software programs, the sequence information provided herein can be readily extended to confirm, or confirm a predicted, gene having the sequence of the polynucleotides described in the present invention. Further the information obtained can be used to identify the function of the gene product of the gene corresponding to the polynucleotides described herein. While not necessary to the practice of the invention, identification of the function of the corresponding gene, can provide guidance in the design of therapeutics that target the gene to modulate its activity and modulate the cancerous phenotype (e.g., inhibit metastasis, proliferation, and the like).

Example 58

Source of Biological Materials

The biological materials used in the experiments that led to the present invention are described below.

Source of Patient Tissue Samples

Normal and cancerous tissues were collected from patients using laser capture microdissection (LCM) techniques, which techniques are well known in the art (see, e.g., Ohyama et al. (2000) Biotechniques 29:530-6; Curran et al. (2000) Mol. Pathol. 53:64-8; Suarez-Quian et al. (1999) Biotechniques 26:328-35; Simone et al. (1998) Trends Genet 14:272-

6; Conia et al. (1997) J. Clin. Lab. Anal. 11:28-38; Emmert-Buck et al. (1996) Science 274:998-1001). Table 34 provides information about each patient from which colon tissue samples were isolated, including: the Patient ID ("PT ID") and Path ReportID ("Path ID"), which are numbers assigned to the patient and the pathology reports for identification purposes; the group ("Grp") to which the patients have been assigned; the anatomical location of the tumor ("Anatom Loc"); the primary tumor size ("Size"); the primary tumor grade ("Grade"); the identification of the histopathological grade ("Histo Grade"); a description of local sites to which the tumor had invaded ("Local Invasion"); the presence of lymph node metastases ("Lymph Met"); the incidence of lymph node metastases (provided as a number of lymph nodes positive for metastasis over the number of lymph nodes examined) ("Lymph Met Incid"); the regional lymphnode grade ("Reg Lymph Grade"); the identification or detection of metastases to sites distant to the tumor and their location ("Dist Met & Loc"); the grade of distant metastasis ("Dist Met Grade"); and general comments about the patient or the tumor ("Comments"). Histopathology of all primary tumors indicated the tumor was adenocarcinoma except for Patient ID Nos. 130 (for which no information was provided), 392 (in which greater than 50% of the cells were mucinous carcinoma), and 784 (adenosquamous carcinoma). Extranodal extensions were described in three patients, Patient ID Nos. 784, 789, and 791. Lymphovascular invasion was described in Patient ID Nos. 128, 228, 278, 517, 534, 784, 786, 789, 791, 890, and 892. Crohn's-like infiltrates were described in seven patients, Patient ID Nos. 52, 264, 268, 392, 393, 784, and 791.

TABLE 34

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 10 | 16 | III | Cecum | 8.5 | T3 | G2 | through muscularis propria approaching pericolic fat, but not at serosal surface | Pos | 1/17 | N1 | Neg | M0 | Moderately differentiated |
| 15 | 21 | III | Ascending colon | 4.0 | T3 | G2 | Extending into subserosal adipose tissue | Pos | 3/8 | N1 | Neg | MX | invasive adeno-carcinoma, moderately differentiated; focal perineural invasion is seen |
| 52 | 71 | II | Cecum | 9.0 | T3 | G3 | Invasion through muscularis propria, subserosal involvement; ileocec. valve involvement | Neg | 0/12 | N0 | Neg | M0 | Hyperplastic polyp in appendix. |
| 121 | 140 | II | Sigmoid | 6 | T4 | G2 | Invasion of muscularis propria into serosa, involving submucosa of urinary bladder | Neg | 0/34 | N0 | Neg | M0 | Perineural invasion; donut anastomosis Neg. One tubulovillous and one tubular adenoma with no high grade dysplasia. |
| 125 | 144 | II | Cecum | 6 | T3 | G2 | Invasion through the muscularis propria into suserosal adipose tissue. Ileocecal junction. | Neg | 0/19 | N0 | Neg | M0 | patient history of metastatic melanoma |
| 128 | 147 | III | Transverse colon | 5.0 | T3 | G2 | Invasion of muscularis propria into percolonic fat | Pos | 1/5 | N1 | Neg | M0 | |
| 130 | 149 | | Splenic flexure | 5.5 | T3 | | through wall and into surrounding adipose tissue | Pos | 10/24 | N2 | Neg | M1 | |
| 133 | 152 | II | Rectum | 5.0 | T3 | G2 | Invasion through muscularis propria into non-peritonealized pericolic tissue; gross configuration is annular. | Neg | 0/9 | N0 | Neg | M0 | Small separate tubular adenoma (0.4 cm) |
| 141 | 160 | IV | Cecum | 5.5 | T3 | G2 | Invasion of muscularis propria into pericolonic adipose tissue, but not through serosa. Arising from tubular adenoma. | Pos | 7/21 | N2 | Pos - Liver | M1 | Perineural invasion identified adjacent to metastatic adeno-carcinoma. |

TABLE 34-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 156 | 175 | III | Hepatic flexure | 3.8 | T3 | G2 | Invasion through mucsularis propria into subserosa/pericolic adipose, no serosal involvement. Gross configuration annular. | Pos | 2/13 | N1 | Neg | M0 | Separate tubolovillous and tubular adenomas |
| 228 | 247 | III | Rectum | 5.8 | T3 | G2 to G3 | Invasion through muscularis propria to involve subserosal, perirectoal adipose, and serosa | Pos | 1/8 | N1 | Neg | MX | Hyperplastic polyps |
| 264 | 283 | II | Ascending colon | 5.5 | T3 | G2 | Invasion through muscularis propria into subserosal adipose tissue. | Neg | 0/10 | N0 | Neg | M0 | Tubulovillous adenoma with high grade dysplasia |
| 266 | 285 | III | Transverse colon | 9 | T3 | G2 | Invades through muscularis propria to involve pericolonic adipose, extends to serosa. | Neg | 0/15 | N1 | Pos - Mesenteric deposit | MX | |
| 267 | 286 | III | Ileocecal | 4.5 | T2 | G2 | Confined to muscularis propria | Pos | 2/12 | N1 | Neg | M0 | |
| 268 | 287 | I | Cecum | 6.5 | T2 | G2 | Invades full thickness of muscularis propria, but mesenteric adipose free of malignancy | Neg | 0/12 | N0 | Neg | M0 | |
| 278 | 297 | III | Rectum | 4 | T3 | G2 | Invasion into perirectal adipose tissue. | Pos | 7/10 | N2 | Neg | M0 | Descending colon polyps, no HGD or carcinoma identified . . . |
| 295 | 314 | II | Ascending colon | 5.0 | T3 | G2 | Invasion through muscularis propria into percolic adipose tissue. | Neg | 0/12 | N0 | Neg | M0 | Melanosis coli and diverticular disease. |
| 296 | 315 | III | Cecum | 5.5 | T3 | G2 | Invasion through muscularis propria and invades pericolic adipose tissue. Ileocecal junction. | Pos | 2/12 | N1 | Neg | M0 | Tubulovillous adenoma (2.0 cm) with no high grade dysplasia. Neg. liver biopsy. |
| 300 | 319 | III | Descending colon | 5.2 | T2 | G2 | through the muscularis propria into pericolic fat | Pos | 2/2 | N1 | Neg | M0 | |
| 322 | 341 | II | Sigmoid | 7 | T3 | G2 | through the muscularis propria into pericolic fat | Neg | 0/5 | N0 | Neg | M0 | vascular invasion is identified |
| 339 | 358 | II | Recto-sigmoid | 6 | T3 | G2 | Extends into perirectal fat but does not reach serosa | Neg | 0/6 | N0 | Neg | M0 | 1 hyperplastic polyp identified |
| 341 | 360 | II | Ascending colon | 2 cm invasive | T3 | G2 | Invasion through muscularis propria to involve pericolonic fat. Arising from villous adenoma. | Neg | 0/4 | N0 | Neg | MX | |
| 356 | 375 | II | Sigmoid | 6.5 | T3 | G2 | Through colon wall into subserosal adipose tissue. No serosal spread seen. | Neg | 0/4 | N0 | Neg | M0 | |
| 360 | 412 | III | Ascending colon | 4.3 | T3 | G2 | Invasion thru muscularis propria to pericolonic fat | Pos | 1/5 | N1 | Neg | M0 | Two mucosal polyps |

TABLE 34-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 392 | 444 | IV | Ascending colon | 2 | T3 | G2 | Invasion through muscularis propria into subserosal adipose tissue, not serosa. | Pos | 1/6 | N1 | Pos - Liver | M1 | Tumor arising at prior ileocolic surgical anastomosis. |
| 393 | 445 | II | Cecum | 6.0 | T3 | G2 | Cecum, invades through muscularis propria to involve subserosal adipose tissue but not serosa. | Neg | 0/21 | N0 | Neg | M0 | |
| 413 | 465 | IV | Cecum | 4.8 | T3 | G2 | Invasive through muscularis to involve periserosal fat; abutting ileocecal junction. | Neg | 0/7 | N0 | Pos - Liver | M1 | rediagnosis of oophorectomy path to metastatic colon cancer. |
| 452 | 504 | II | Ascending colon | 4 | T3 | G2 | through muscularis propria approaching pericolic fat, but not at serosal surface | Neg | 0/39 | N0 | Neg | M0 | |
| 505 | 383 | IV | | 7.5 | T3 | G2 | Invasion through muscularis propria involving pericolic adipose, serosal surface uninvolved | Pos | 2/17 | N1 | Pos - Liver | M1 | Anatomical location of primary not notated in report. Evidence of chronic colitis. |
| 517 | 395 | IV | Sigmoid | 3 | T3 | G2 | penetrates muscularis propria, involves pericolonic fat. | Pos | 6/6 | N2 | Neg | M0 | No mention of distant met in report |
| 534 | 553 | II | Ascending colon | 12 | T3 | G3 | Invasion through the muscularis propria involving pericolic fat. Serosa free of tumor. | Neg | 0/8 | N0 | Neg | M0 | Omentum with fibrosis and fat necrosis. Small bowel with acute and chronic serositis, focal abscess and adhesions. |
| 546 | 565 | IV | Ascending colon | 5.5 | T3 | G2 | Invasion through muscularis propria extensively through submucosal and extending to serosa. | Pos | 6/12 | N2 | Pos - Liver | M1 | |
| 577 | 596 | II | Cecum | 11.5 | T3 | G2 | Invasion through the bowel wall, into suberosal adipose. Serosal surface free of tumor. | Neg | 0/58 | N0 | Neg | M0 | Appendix dilated and fibrotic, but not involved by tumor |
| 695 | 714 | II | Cecum | 14.0 | T3 | G2 | extending through bowel wall into serosal fat | Neg | 0/22 | N0 | Neg | MX | moderately differentiated adeno-carcinoma with mucinous diferentiation (% not stated), tubular adenoma and hyperplstic polyps present, |
| 784 | 803 | IV | Ascending colon | 3.5 | T3 | G3 | through muscularis propria into pericolic soft tissues | Pos | 5/17 | N2 | Pos - Liver | M1 | invasive poorly differentiated adenosquamous carcinoma |

TABLE 34-continued

| Pt ID | Path ID | Grp | Anatom Loc | Size | Grade | Histo Grade | Local Invasion | Lymph Met | Lymph Met Incid | Reg Lymph Grade | Dist Met & Loc | Dist Met Grade | Comment |
|---|---|---|---|---|---|---|---|---|---|---|---|---|---|
| 786 | 805 | IV | Descending colon | 9.5 | T3 | G2 | through muscularis propria into pericolic fat, but not at serosal surface | Neg | 0/12 | N0 | Pos - Liver | M1 | moderately differentiated invasive adenocarcinoma |
| 787 | 806 | II | Rectosigmoid | 2.5 | T3 | G2–G3 | Invasion of muscularis propria into soft tissue | Neg | | N0 | Neg | MX | Peritumoral lymphocytic response; 5 LN examined in pericolic fat, no metastatases observed. |
| 789 | 808 | IV | Cecum | 5.0 | T3 | G2–G3 | Extending through muscularis propria into pericolonic fat | Pos | 5/10 | N2 | Pos - Liver | M1 | Three fungating lesions examined. |
| 790 | 809 | IV | Rectum | 6.8 | T3 | G1–G2 | Invading through muscularis propria into perirectal fat | Pos | 3/13 | N1 | Pos - Liver | M1 | |
| 791 | 810 | IV | Ascending colon | 5.8 | T3 | G3 | Through the muscularis propria into pericolic fat | Pos | 13/25 | N2 | Pos - Liver | M1 | poorly differentiated invasive colonic adenocarcinoma |
| 888 | 908 | IV | Ascending colon | 2.0 | T2 | G1 | Into muscularis propria | Pos | 3/21 | N0 | Pos - Liver | M1 | well to moderately differentiated adenocarcinomas; this patient has tumors of the ascending colon and the sigmoid colon |
| 889 | 909 | IV | Cecum | 4.8 | T3 | G2 | Through muscularis propria int subserosal tissue | Pos | 1/4 | N1 | Pos - Liver | M1 | moderately differentiated adenocarcinoma |
| 890 | 910 | IV | Ascending colon | | T3 | G2 | Through muscularis propria into subserosa. | Pos | 11/15 | N2 | Pos - Liver | M1 | |
| 891 | 911 | IV | Rectum | 5.2 | T3 | G2 | Invasion through muscularis propria into perirectal soft tissue | Pos | 4/15 | N2 | Pos - Liver | M1 | Perineural invasion present. |
| 892 | 912 | IV | Sigmoid | 5.0 | T3 | G2 | Invasion into pericolic sort tissue. Tumor focally invading skeletal muscle attached to colon. | Pos | 1/28 | N1 | Pos - Liver, left and right lobe, omentum | M1 | Perineural invasion present, extensive. Patient with a history of colon cancer. |
| 893 | 913 | IV | Transverse colon | 6.0 | T3 | G2–G3 | Through muscularis propria into pericolic fat | Pos | 14/17 | N2 | Pos - Liver | M1 | Perineural invasion focally present. Omentum mass, but resection with no tumor identified. |
| 989 | 1009 | IV | Sigmoid | 6.0 | T3 | G2 | Invasion through colon wall and focally involving subserosal tissue. | Pos | 1/7 | N1 | Pos - Liver | M1 | Primary adenocarcinoma arising from tubulovillous adenoma. |

Two overlapping groups of patients described in Table 34 were studied. The first group contained 33 members whereas the second group contained 22 members. In the case of the first group of patients, gene product expression profiles of tissue samples from metastasized tumors were compared to gene product expression profiles of an "unmatched" sample, where the unmatched sample is a pool of samples of normal colon from the sample patients. For the second group of patients, gene product expression profiles of tissue samples from metastasized tumors were compared to gene product expression profiles of a "matched" sample, where the matched sample is matched to a single sample within a patient. As such, a metastasized colon tumor sample is "matched" with a normal colon sample or a primary colon tumor from the same patient. Metastases of colon cancers may appear in any tissue, including bone, breast, lung, liver, brain, kidney skin, intestine, appendix, etc. In many patients, the colon cancer had metastasized to liver.

Source of Polynucleotides on Arrays

Polynucleotides for use on the arrays were obtained from both publicly available sources and from cDNA libraries generated from selected cell lines and patient tissues. Table 35 provides information about the polynucleotides on the arrays including: (1) the "SEQ ID NO" assigned to each sequence for use in the present specification; (2) the spot identification number ("Spot ID"), an internal reference that serves as a unique identifier for the spot on the array; (3) the "Clone ID" assigned to the clone from which the sequence was isolated; and (4) the "MAClone ID" assigned to the clone from which the sequence was isolated. The sequences corresponding to the SEQ ID NOS are provided in the Sequence Listing.

Characterization of Sequences

The sequences of the isolated polynucleotides were first masked to eliminate low complexity sequences using the RepeatMasker masking program, publicly available through a web site supported by the University of Washington (See also Smit, A. F. A. and Green, P., unpublished results). Generally, masking does not influence the final search results, except to eliminate sequences of relatively little interest due to their low complexity, and to eliminate multiple "hits" based on similarity to repetitive regions common to multiple sequences, e.g., Alu repeats. Masking resulted in the elimination of several sequences.

The remaining sequences of the isolated polynucleotides were used in a homology search of the GenBank database using the TeraBLAST program (TimeLogic, Crystal Bay, Nev.), a DNA and protein sequence homology searching algorithm. TeraBLAST is a version of the publicly available BLAST search algorithm developed by the National Center for Biotechnology, modified to operate at an accelerated speed with increased sensitivity on a specialized computer hardware platform. The program was run with the default parameters recommended by TimeLogic to provide the best sensitivity and speed for searching DNA and protein sequences. Gene assignment for the query sequences was determined based on best hit from the GenBank database; expectancy values are provided with the hit.

Summary of TeraBLAST Search Results

Table 36 provides information about the gene corresponding to each polynucleotide. Table 36 includes: (1) the "SEQ ID NO" of the sequence; (2) the "Clone ID" assigned to the clone from which the sequence was isolated; (3) the "MAClone ID" assigned to the clone from which the sequence was isolated; (4) the library source of the clone ("PatientType") (5) the GenBank Accession Number of the publicly available sequence corresponding to the polynucleotide ("GBHit"); (6) a description of the GenBank sequence ("GBDescription"); and (7) the score of the similarity of the polynucleotide sequence and the GenBank sequence ("GBScore"). The published information for each GenBank and EST description, as well as the corresponding sequence identified by the provided accession number, are incorporated herein by reference.

Example 59

Detection of Differential Expression Using Arrays cDNA probes were prepared from total RNA isolated from the patient samples described above. Since LCM provides for the isolation of specific cell types to provide a substantially homogenous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) *Nature Med* 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from a normal cell RNA sample. For example, the cDNA probes from the normal cells were labeled with Cy3 fluorescent dye (green) and the cDNA probes prepared from the tumor cells were labeled with Cy5 fluorescent dye (red), and vice versa.

Each array used had an identical spatial layout and control spot set. Each microarray was divided into two areas, each area having an array with, on each half, twelve groupings of 32×12 spots, for a total of about 9,216 spots on each array. The two areas are spotted identically which provides for at least two duplicates of each clone per array.

Polynucleotides for use on the arrays were obtained from both publicly available sources and from cDNA libraries generated from selected cell lines and patient tissues as described above and in Table 33. PCR products of from about 0.5 kb to 2.0 kb amplified from these sources were spotted onto the array using a Molecular Dynamics Gen III spotter according to the manufacturer's recommendations. The first row of each of the 24 regions on the array had about 32 control spots, including 4 negative control spots and 8 test polynucleotides. The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about four duplicate measurements for each clone, two of one color and two of the other, for each sample.

The differential expression assay was performed by mixing equal amounts of probes from matched or unmatched samples. The arrays were pre-incubated for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level of fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p>10^{-3}$, and the differential ratio was set to 1.000 for those spots. All other spots have a significant difference in expression between the matched or unmatched samples. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level ($p>0.05$).

Table 37 provides the results for gene products that were over- or under-expressed as determined by comparison of matched or unmatched pairs of samples isolated from the two patient groups described above. The results show data from three separate experiments using the same set of gene products, each identified by SEQ ID NO. The three experiments are: 1) a comparison of the gene expression profile of metastasized colon tumor tissue compared to unmatched normal colon tissue ("unmatched metastasis/normal"); 2) a comparison of the gene expression profile of metastasized colon tumor tissue compared to normal colon tissue from the same patient ("matched metastasis/normal"); and 3) a comparison of the gene expression profile of metastasized colon tumor tissue compared to primary tumor tissue from the same patient ("matched metastasis/tumor"). If samples are matched, they are both samples from a single patient. If samples are unmatched, one sample is obtained from a patient, and compared to pooled samples from many patients.

The results in Table 37 show the sequences that are induced by at least 2-fold or greater in the metastasized colon tumor samples relative to normal or primary tumor tissue samples in at least 20% of the patients tested, or gene products in which expression levels of the gene in metastasized colon tumor cells was less than or equal to ½ of the expression level in normal or primary tissue samples in at least 20% of the patients tested. Table 37 includes: (1) the "SEQ ID NO" of the sequence tested; (2) the "Clone ID" assigned to the clone from which the sequence was isolated; and (3) the "MAClone ID" assigned to the clone from which the sequence was isolated; (4) the percentage of patients tested in which expression levels (e.g., as message level) of a particular sequence was at least 2-fold greater in metastasized colon cancer tissue than in unmatched or matched colon tissue (">=2×"); (5) the percentage of patients tested in which expression levels (e.g., as message level) of the gene was less than or equal to ½ of the expression level in matched or unmatched colon tissue ("<=halfx"); and (6) the number of patients analyzed in each experiment ("Ratios").

These data provide evidence that the genes represented by the polynucleotides having the indicated sequences are differentially expressed in colon cancer, particularly metastasized colon cancer, as compared to colon cancer primary tumors or normal non-cancerous colon tissue.

Example 60

Antisense Regulation of Gene Expression

The expression of the differentially expressed genes represented by the polynucleotides in the cancerous cells can be analyzed using antisense knockout technology to confirm the role and function of the gene product in tumorigenesis, e.g., in promoting a metastatic phenotype.

A number of different oligonucleotides complementary to the mRNA generated by the differentially expressed genes identified herein can be designed as potential antisense oligonucleotides, and tested for their ability to suppress expression of the genes. Sets of antisense oligomers specific to each candidate target are designed using the sequences of the polynucleotides corresponding to a differentially expressed gene and the software program HYBsimulator Version 4 (available for Windows 95/Windows NT or for Power Macintosh, RNAture, Inc. 1003 Health Sciences Road, West, Irvine, Calif. 92612 USA). Factors that are considered when designing antisense oligonucleotides include: 1) the secondary structure of oligonucleotides; 2) the secondary structure of the target gene; 3) the specificity with no or minimum cross-hybridization to other expressed genes; 4) stability; 5) length and 6) terminal GC content. The antisense oligonucleotide is designed so that it will hybridize to its target sequence under conditions of high stringency at physiological temperatures (e.g., an optimal temperature for the cells in culture to provide for hybridization in the cell, e.g., about 37° C.), but with minimal formation of homodimers.

Using the sets of oligomers and the HYBsimulator program, three to ten antisense oligonucleotides and their reverse controls are designed and synthesized for each candidate mRNA transcript, which transcript is obtained from the gene corresponding to the target polynucleotide sequence of interest. Once synthesized and quantitated, the oligomers are screened for efficiency of a transcript knock-out in a panel of cancer cell lines. The efficiency of the knock-out is determined by analyzing mRNA levels using lightcycler quantification. The oligomers that resulted in the highest level of transcript knock-out, wherein the level was at least about 50%, preferably about 80-90%, up to 95% or more up to undetectable message, are selected for use in a cell-based proliferation assay, an anchorage independent growth assay, and an apoptosis assay.

The ability of each designed antisense oligonucleotide to inhibit gene expression is tested through transfection into SW620 colon carcinoma cells. For each transfection mixture, a carrier molecule (such as a lipid, lipid derivative, lipid-like molecule, cholesterol, cholesterol derivative, or cholesterol-like molecule) is prepared to a working concentration of 0.5 mM in water, sonicated to yield a uniform solution, and filtered through a 0.45 µm PVDF membrane. The antisense or control oligonucleotide is then prepared to a working concentration of 100 µM in sterile Millipore water. The oligonucleotide is further diluted in OptiMEM™ (Gibco/BRL), in a microfuge tube, to 2 µM, or approximately 20 µg oligo/ml of OptiMEM™. In a separate microfuge tube, the carrier molecule, typically in the amount of about 1.5-2 nmol carrier/µg antisense oligonucleotide, is diluted into the same volume of OptiMEM™ used to dilute the oligonucleotide. The diluted antisense oligonucleotide is immediately added to the diluted carrier and mixed by pipetting up and down. Oligonucleotide is added to the cells to a final concentration of 30 nM.

The level of target mRNA that corresponds to a target gene of interest in the transfected cells is quantitated in the cancer cell lines using the Roche LightCycler™ real-time PCR machine. Values for the target mRNA are normalized versus an internal control (e.g., beta-actin). For each 20 µl reaction, extracted RNA (generally 0.2-1 µg total) is placed into a sterile 0.5 or 1.5 ml microcentrifuge tube, and water is added to a total volume of 12.5 µl. To each tube is added 7.5 µl of a buffer/enzyme mixture, prepared by mixing (in the order listed) 2.5 µl $H_2O$, 2.0 µl 10× reaction buffer, 10 µl oligo dT (20 pmol), 1.0 µl dNTP mix (10 mM each), 0.5 µl RNAsin® (20 u) (Ambion, Inc., Hialeah, Fla.), and 0.5 µl MMLV reverse transcriptase (50 u) (Ambion, Inc.). The contents are mixed by pipetting up and down, and the reaction mixture is incubated at 42° C. for 1 hour. The contents of each tube are centrifuged prior to amplification.

An amplification mixture is prepared by mixing in the following order: 1× PCR buffer II, 3 mM $MgCl_2$, 140 µM each dNTP, 0.175 pmol each oligo, 1:50,000 dil of SYBR® Green, 0.25 mg/ml BSA, 1 unit Taq polymerase, and $H_2O$ to 20 µl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 µl aliquot of amplification mixture, 2 µl of template RT is added, and amplification is carried out according to standard protocols. The results are expressed as the percent decrease in expression of the corresponding gene product relative to non-transfected cells, vehicle-only transfected (mock-transfected) cells, or cells transfected with reverse control oligonucleotides.

Example 61

Effect of Expression on Proliferation

The effect of gene expression on the inhibition of cell proliferation can be assessed in, for example, metastatic breast cancer cell lines (MDA-MB-231 ("231")); SW620 colon colorectal carcinoma cells; SKOV3 cells (a human ovarian carcinoma cell line); or LNCaP, PC3, 22Rv1, MDA-PCA-2b, or DU145 prostate cancer cells.

Cells are plated to approximately 60-80% confluency in 96-well dishes. Antisense or reverse control oligonucleotide is diluted to 2 µM in OptiMEM™. The oligonucleotide-OptiMEM™ can then be added to a delivery vehicle, which delivery vehicle can be selected so as to be optimized for the particular cell type to be used in the assay. The oligo/delivery vehicle mixture is then further diluted into medium with serum on the cells. The final concentration of oligonucleotide for all experiments can be about 300 nM.

Antisense oligonucleotides are prepared as described above (see Example 60). Cells are transfected overnight at 37° C. and the transfection mixture is replaced with fresh medium the next morning. Transfection is carried out as described above in Example 60.

Those antisense oligonucleotides inhibit proliferation of SW620 cells indicate that the corresponding gene plays a role in production or maintenance of the cancerous phenotype in cancerous colon cells. Those antisense oligonucleotides that inhibit proliferation in SKOV3 cells represent genes that play a role in production or maintenance of the cancerous phenotype in cancerous breast cells. Those antisense oligonucleotides that result in inhibition of proliferation of MDA-MB-231 cells indicate that the corresponding gene plays a role in production or maintenance of the cancerous phenotype in cancerous ovarian cells. Those antisense oligonucleotides that inhibit proliferation in LNCaP, PC3, 22Rv1, MDA-PCA-2b, or DU145 cells represent genes that play a role in production or maintenance of the cancerous phenotype in cancerous prostate cells.

Example 62

Effect of Gene Expression on Cell Migration

The effect of gene expression on the inhibition of cell migration can be assessed in SW620 colon cancer cells using static endothelial cell binding assays, non-static endothelial cell binding assays, and transmigration assays.

For the static endothelial cell binding assay, antisense oligonucleotides are prepared as described above (see Example 60). Two days prior to use, colon cancer cells (CaP) are plated and transfected with antisense oligonucleotide as described above (see Examples 60 and 61). On the day before use, the medium is replaced with fresh medium, and on the day of use, the medium is replaced with fresh medium containing 2 µM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in DMEM/1% BSA/10 mM HEPES pH 7.0. Finally, CaP cells are counted and resuspended at a concentration of $1 \times 10^6$ cells/mi.

Endothelial cells (EC) are plated onto 96-well plates at 40-50% confluence 3 days prior to use. On the day of use, EC are washed 1× with PBS and 50λ DMDM/1% BSA/10 mM HEPES pH 7 is added to each well. To each well is then added 50K (50□) CaP cells in DMEM/1% BSA/10 mM HEPES pH 7. The plates are incubated for an additional 30 min and washed 5× with PBS containing Ca++ and Mg++. After the final wash, 100 µL PBS is added to each well and fluorescence is read on a fluorescent plate reader (Ab492/Em 516 nm).

For the non-static endothelial cell binding assay, CaP are prepared as described above. EC are plated onto 24-well plates at 30-40% confluence 3 days prior to use. On the day of use, a subset of EC are treated with cytokine for 6 hours then washed 2× with PBS. To each well is then added 150-200K CaP cells in DMEM/1% BSA/10 mM HEPES pH 7. Plates are placed on a rotating shaker (70 RPM) for 30 min and then washed 3× with PBS containing Ca++ and Mg++. After the final wash, 500 µL PBS is added to each well and fluorescence is read on a fluorescent plate reader (Ab492/Em 516 nm).

For the transmigration assay, CaP are prepared as described above with the following changes. On the day of use, CaP medium is replaced with fresh medium containing 5 µM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in EGM-2-MV medium. Finally, CaP cells are counted and resuspended at a concentration of $1 \times 10^6$ cells/ml.

EC are plated onto FluorBlok transwells (BD Biosciences) at 30-40% confluence 5-7 days before use. Medium is replaced with fresh medium 3 days before use and on the day of use. To each transwell is then added 50K labeled CaP. 30 min prior to the first fluorescence reading, 10 µg of FITC-dextran (10K MW) is added to the EC plated filter. Fluorescence is then read at multiple time points on a fluorescent plate reader (Ab492/Em 516 nm).

Those antisense oligonucleotides that result in inhibition of binding of SW620 colon cancer cells to endothelial cells indicate that the corresponding gene plays a role in the production or maintenance of the cancerous phenotype in cancerous colon cells. Those antisense oligonucleotides that result in inhibition of endothelial cell transmigration by SW620 colon cancer cells indicate that the corresponding gene plays a role in the production or maintenance of the cancerous phenotype in cancerous colon cells.

Example 63

Effect of Gene Expression on Colony Formation

The effect of gene expression upon colony formation of SW620 cells, SKOV3 cells, MD-MBA-231 cells, LNCaP cells, PC3 cells, 22Rv1 cells, MDA-PCA-2b cells, and DU145 cells can be tested in a soft agar assay. Soft agar assays are conducted by first establishing a bottom layer of 2 ml of 0.6% agar in media plated fresh within a few hours of layering on the cells. The cell layer is formed on the bottom layer by removing cells transfected as described above from plates using 0.05% trypsin and washing twice in media. The cells are counted in a Coulter counter, and resuspended to $10^6$ per ml in media. 10 µl aliquots are placed with media in 96-well plates (to check counting with WST1), or diluted further for the soft agar assay. 2000 cells are plated in 800 µl 0.4% agar in duplicate wells above 0.6% agar bottom layer. After the cell layer agar solidifies, 2 ml of media is dribbled on top and antisense or reverse control oligo (produced as described in Example 60) is added without delivery vehicles. Fresh media and oligos are added every 3-4 days. Colonies form in 10 days to 3 weeks. Fields of colonies are counted by eye. WST-1 metabolism values can be used to compensate for small differences in starting cell number. Larger fields can be scanned for visual record of differences.

Those antisense oligonucleotides that result in inhibition of colony formation of SW620 cells indicate that the corresponding gene plays a role in production or maintenance of the cancerous phenotype in cancerous colon cells. Those antisense oligonucleotides that inhibit colony formation in SKOV3 cells represent genes that play a role in production or maintenance of the cancerous phenotype in cancerous breast cells. Those antisense oligonucleotides that result in inhibition of colony formation of MDA-MB-231 cells indicate that the corresponding gene plays a role in production or maintenance of the cancerous phenotype in cancerous ovarian cells. Those antisense oligonucleotides that inhibit colony formation in LNCaP, PC3, 22Rv1, MDA-PCA-2b, or DU145 cells represent genes that play a role in production or maintenance of the cancerous phenotype in cancerous prostate cells.

Example 64

Induction of Cell Death Upon Depletion of Polypeptides by Depletion of mRNA ("Antisense Knockout")

In order to assess the effect of depletion of a target message upon cell death, SW620 cells, or other cells derived from a cancer of interest, can be transfected for proliferation assays. For cytotoxic effect in the presence of cisplatin (cis), the same protocol is followed but cells are left in the presence of 2 µM drug. Each day, cytotoxicity is monitored by measuring the amount of LDH enzyme released in the medium due to membrane damage. The activity of LDH is measured using the Cytotoxicity Detection Kit from Roche Molecular Biochemicals. The data is provided as a ratio of LDH released in the medium vs. the total LDH present in the well at the same time point and treatment (rLDH/tLDH). A positive control using antisense and reverse control oligonucleotides for BCL2 (a known anti-apoptotic gene) is included; loss of message for BCL2 leads to an increase in cell death compared with treatment with the control oligonucleotide (background cytotoxicity due to transfection).

Example 65

Reduction of Colon Cancer In Vivo

In order to assess the effect of depletion of a target message upon colon cancer metastasis and the growth of metastasized colon cancer cells in vivo, a mouse model is utilized. Mouse models for cancer metastasis are well known in the art (e.g. Hubbard et al Dis Colon Rectum. 2002 45:334-41; Rashidi et al Clin Cancer Res. 2000 6:2556-61; Rashidi et al Anticancer Res. 2000 20:715-22; Rho et al Anticancer Res. 1999 19:157-61; Hasegawa et al, Int J Cancer 1998 76-812-6; and Warren et al J Clin Invest. 1995 95:1789-97.

In one model, before, at the same time as, or sometime after the intravenous or intraperitoneal administration of cancer cells to a model mouse, antisense molecules of Example 60 or other inhibitory molecules are administered to the model mouse. Cancer progression, including establishment and

Example 66

Functional Analysis of Gene Products Differentially Expressed in Colon Cancer in Patients The gene products of sequences of a gene differentially expressed in cancerous cells can be further analyzed to confirm the role and function of the gene product in tumorigenesis, e.g., in promoting or inhibiting development of a metastatic phenotype. For example, the function of gene products corresponding to genes identified herein can be assessed by blocking function of the gene products in the cell. For example, where the gene product is secreted or associated with a cell surface membrane, blocking antibodies can be generated and added to cells to examine the effect upon the cell phenotype in the context of, for example, the transformation of the cell to a cancerous, particularly a metastatic, phenotype. In order to generate antibodies, a clone corresponding to a selected gene product is selected, and a sequence that represents a partial or complete coding sequence is obtained. The resulting clone is expressed, the polypeptide produced isolated, and antibodies generated. The antibodies are then combined with cells and the effect upon tumorigenesis assessed.

Where the gene product of the differentially expressed genes identified herein exhibits sequence homology to a protein of known function (e.g., to a specific kinase or protease) and/or to a protein family of known function (e.g., contains a domain or other consensus sequence present in a protease family or in a kinase family), then the role of the gene product in tumorigenesis, as well as the activity of the gene product, can be examined using small molecules that inhibit or enhance function of the corresponding protein or protein family.

Additional functional assays include, but are not necessarily limited to, those that analyze the effect of expression of the corresponding gene upon cell cycle and cell migration. Methods for performing such assays are well known in the art.

Example 67

Contig Assembly and Additional Gene Characterization

The sequences of the polynucleotides provided in the present invention can be used to extend the sequence information of the gene to which the polynucleotides correspond (e.g., a gene, or mRNA encoded by the gene, having a sequence of the polynucleotide described herein). This expanded sequence information can in turn be used to further characterize the corresponding gene, which in turn provides additional information about the nature of the gene product (e.g., the normal function of the gene product). The additional information can serve to provide additional evidence of the gene product's use as a therapeutic target, and provide further guidance as to the types of agents that can modulate its activity.

In one example, a contig is assembled using a sequence of a polynucleotide of the present invention, which is present in a clone. A "contig" is a contiguous sequence of nucleotides that is assembled from nucleic acid sequences having overlapping (e.g., shared or substantially similar) sequence information. The sequences of publicly-available ESTs (Expressed Sequence Tags) and the sequences of various clones from several cDNA libraries synthesized at Chiron can be used in the contig assembly.

The contig is assembled using the software program Sequencher, version 4.05, according to the manufacturer's instructions and an overview alignment of the contiged sequences is produced. The sequence information obtained in the contig assembly can then be used to obtain a consensus sequence derived from the contig using the Sequencher program. The consensus sequence is used as a query sequence in a TeraBLASTN search of the DGTI DoubleTwist Gene Index (DoubleTwist, Inc., Oakland, Calif.), which contains all the EST and non-redundant sequence in public databases.

Through contig assembly and the use of homology searching software programs, the sequence information provided herein can be readily extended to confirm, or confirm a predicted, gene having the sequence of the polynucleotides described in the present invention. Further the information obtained can be used to identify the function of the gene product of the gene corresponding to the polynucleotides described herein. While not necessary to the practice of the invention, identification of the function of the corresponding gene, can provide guidance in the design of therapeutics that target the gene to modulate its activity and modulate the cancerous phenotype (e.g., inhibit metastasis, proliferation, and the like).

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

---

SEQUENCE LISTING (14066 sequences)

SEQ ID NO: 1 - DNA, 300 bp, Homo sapiens
ctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagagga

SEQ ID NO: 2 - DNA, 760 bp, Homo sapiens
  misc_feature 2, 3, 338, 381, 391, 395, 408, 425, 434, 452, 461, 490, 512,570, 577, 584, 597, 599, 613, 656, 692, 707, 711, 725, 742,745: n = A,T,C or G
tnnaatatacagctacttgttctttttgcaggatcccatcgattcgaattccgttgctgtcgcacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggatggacagattcctggtgaaaggggctcaagggggccttttgaggaagcaggatgagcangagccaactggagaagagccagctgtgttgggaggagacaaanaaagcacaangaanaggcccatgaganagccccagggaatggangccactcancaagccctagctggcggnacattcggncttagggcctggactgcagttacacagtnctgtttggcaaagctgaggcanatgagattttccaagagttggagaaagaagtagaatattttacaggagcactggccanagtccangtattcnggaagtggcacantntgcccaggaagcangccaacgtattggcgacgcttgggctgaactacacattttcangccttacgctgtcttccaaagccctgggatcccaanttcttagaaccccantccnggatcaaccttttntgggggtgactgggacngancctttaacttttttg

SEQ ID NO: 3 - DNA, 754 bp, Homo sapiens
  misc_feature 1, 9, 12, 16, 22, 271, 463, 550, 606, 608, 620, 659, 660,667, 694, 695, 712, 734, 739, 749: n = A,T,C or G
ntatccttncanttcntatatnaggctacttgttctttttgcaggatcccatcgattcgaattcggcacgagggcagcatggcgtccgtggcgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcanaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctngggagcactgctgggttctctatgtggatgtgctgcttctggaatgtggtggaaatttgttttgatgccatttccattgctgtaaangctgctctcttcaatacaagggataccaaagggttcgagtttttggaaggatgaanangggtctaaggancatttgaattgtccagatgacccttatgactgcattacnnactaaantgtgggaagaatgtcccctggcattgnnacttttgttgcaaaganttggcttttcggcatgttggtnggatncctactcttnaagga

SEQ ID NO: 4 - DNA, 234 bp, Homo sapiens
aaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaa

SEQ ID NO: 5 - DNA, 149 bp, Homo sapiens
  misc_feature 4, 34, 69: n = A,T,C or G
gctncagtctggtcatgtcacagcccctcctggnaccgcacggccctagtatttacacaaccttcacgnacagttggtgattggctggatgccatcaagatggggcggtacaaggagagcttcgtcagtgcggggtttgcatcttttga

SEQ ID NO: 6 - DNA, 224 bp, Homo sapiens
ggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccagatcgcactcaagcttgttggccc

SEQ ID NO: 7 - DNA, 259 bp, Homo sapiens
caaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctg

SEQ ID NO: 8 - DNA, 281 bp, Homo sapiens
gcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcatgcggctgaggtcc

SEQ ID NO: 9 - DNA, 282 bp, Homo sapiens
cgtggttttgtctgctgcgcccgctcttcgcgctctcgtttcattttctgcggcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctc

SEQ ID NO: 10 - DNA, 260 bp, Homo sapiens
gcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaagg

SEQ ID NO: 11 - DNA, 239 bp, Homo sapiens
  misc_feature 168, 190, 203, 229: n = A,T,C or G
gttgccctgcctctggctccagaacagaaagggagcctcacgctggctcacacaaaacagctgacactgactaaggaactgcagcatttgcacaggggaggggggtgcctccttcctagaggccctgggggccaggctgattggggggcagattgacataggccccantcatcagatgtctgaaattcancacgggggtaacntggggggttagggactatttttaaantaggggtggc

SEQ ID NO: 12 - DNA, 160 bp, Homo sapiens
gcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctc

SEQ ID NO: 13 - DNA, 260 bp, Homo sapiens
  misc_feature 224, 225, 231, 232: n = A,T,C or G
ctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccnnaaaggnngaaaggagaaaaaagggcatcatccccc

SEQ ID NO: 14 - DNA, 264 bp, Homo sapiens
  misc_feature 115, 141, 143, 164, 165, 168, 214, 219, 234, 238, 251, 256,259, 261, 262: n = A,T,C or G
aacaaattgaaggttaacaccttaagagttgtagttactgaccagaaatatggacagacttcttagacttggaggaggtatgcctggactgggccaggggccacctacagatgcncctgcagtggacacagcagaacaagncnatatctcttccctggcactgnnaanaatgttaaaacatggccgtgctggagttccaatggaagttatgggnttgangcttggagaatttgntgangattataccgtcngagtnatngnngt

SEQ ID NO: 15 - DNA, 259 bp, Homo sapiens
  misc_feature 111: n = A,T,C or G
cgtggccaaggagttgggtgagaacctgactgatgaggagctgcaggaaatgattgatgaagctgatcgagatggagatggagaggtcagtgagcaagagttcctgcgcanatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatag

SEQ ID NO: 16 - DNA, 233 bp, Homo sapiens
gctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccag

SEQ ID NO: 17 - DNA, 188 bp, Homo sapiens
aaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccg

SEQ ID NO: 18 - DNA, 200 bp, Homo sapiens
gtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaat

SEQ ID NO: 19 - DNA, 647 bp, Homo sapiens
  misc_feature 580, 646: n = A,T,C or G
gcggcctacggctgcgagaagacgacagaagggagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaattcgaatttcctggcttataaactttttaaattacatttgaaatataaaccaaatgaaatattttactgataagattcttcatgcttctttgctctccttaaaatgtctttttcactagttagttccaagggacagnctcataattttggtcttatactttgatttcctttttcttttttttttttaaaaaaagggggggganc

SEQ ID NO: 20 - DNA, 218 bp, Homo sapiens
tgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgg

SEQ ID NO: 21 - DNA, 207 bp, Homo sapiens
  misc_feature 77: n = A,T,C or G
gctgcccttgtagcttccccagaccccaactcactgcagttcatctgaacaacctgagctcctgggccggggtgganggagggggataaacctaaggccctgatccaaagcagcctgttgagctggttctccagggctgcagtctctccaggtgtacagctgctgtccctgccctgtcctgtccttgcacagtctcctatgtctgag

SEQ ID NO: 22 - DNA, 204 bp, Homo sapiens
cccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggg

SEQ ID NO: 23 - DNA, 224 bp, Homo sapiens
  misc_feature 62, 199, 212, 220: n = A,T,C or G
agcaaatctggctatcttctccatccagtggacctaagcgttatgactggactgggaaaaantgggtgtactcccacgacggcgtgtccctccatgagctgctggccgcagagctcactaaagccttaaaaaccaaactggacttgtcttccttggcctattccggaaaagatgcttgatgcccagcccggtttaaagncattaaaagtatnaggccagncccc

SEQ ID NO: 24 - DNA, 228 bp, Homo sapiens
aaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacct

SEQ ID NO: 25 - DNA, 234 bp, Homo sapiens
  misc_feature 146: n = A,T,C or G
ctcgagccgctcgagccgaattcggctcgaggccaaaagatgttattggagctattttgtaaggtcccacatttgaccaaggagtgcctggtagcgttgagatgtgggagagaatgcactgatctgaaggcagccctgcgtcaggnattcagcaacctggaagagattcttgagtatcagaacaccaccttctttggtggaacctgtatatccatgattgattacctcctctgg

SEQ ID NO: 26 - DNA, 239 bp, Homo sapiens
cggctcgaggcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgag

SEQ ID NO: 27 - DNA, 225 bp, Homo sapiens
  misc_feature 147: n = A,T,C or G
ccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctgganagtgggggcttccgctccctgctcatcaacgctgtggaggcctcctgcatccgcacacgggagctgcagtccatggct

SEQ ID NO: 28 - DNA, 200 bp, Homo sapiens
cggctcgagcccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaa

SEQ ID NO: 29 - DNA, 178 bp, Homo sapiens
tctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgt

SEQ ID NO: 30 - DNA, 233 bp, Homo sapiens
  misc_feature 8, 70, 81, 232: n = A,T,C or G
ggaaagangttttgatataaacaaaacaaatgcactttgggtgtgttttggtatttttctggggatacanggggtggggtnagggatgtccctgtagattagttccagaatggggtgtctgtatatactgtattaataggcatgtttgactctcgtaaagggacgttagtagctgctgcaggtcctgtttggaaaccccatgtacaattcccagttttttgtaagtgtcagng

SEQ ID NO: 31 - DNA, 762 bp, Homo sapiens
  misc_feature 615, 632, 709, 710, 711, 712, 713, 714, 715, 716, 717, 718,719, 720, 721, 722, 723, 724, 725, 726, 727, 728, 729, 730,731, 732, 761: n = A,T,C or G
gcggcctacggctgcgagaagacgacagaaggggagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctncttcaagcattctgtcnaccctggatgttgaattgccacctgtttgctgtgacatagatatttaaatttcttagtgcttcagagtttgggtggnnnnnnnnnnnnnnnnnnnnnnnnaacaaaaaaaaaaaaaaaaaaaaaaaaang

SEQ ID NO: 32 - DNA, 315 bp, Homo sapiens
aacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagtggtgg

SEQ ID NO: 33 - DNA, 275 bp, Homo sapiens
ggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccg

SEQ ID NO: 34 - DNA, 206 bp, Homo sapiens
gggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattc

SEQ ID NO: 35 - DNA, 257 bp, Homo sapiens
  misc_feature 74: n = A,T,C or G
gagccaccaccaccatagcccagccagatgagtgctctgtggacccacagcctaagctgagtgtgaccccagangccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaag

SEQ ID NO: 36 - DNA, 235 bp, Homo sapiens
  misc_feature 109: n = A,T,C or G
ctcgagccgggattttctgttttcggaagttgctgggttcgttttattcagcggcagtggtgctttcccgaatctcagaatgcctgttaaaagatcactgaagttgganggtctgttagaagaaaattcatttgatccttcaaaaatcacaaggaagaaaagtgttataacttattctccaacaactggaacttgtcaaatgagtctatttgcttctcccacaagttctgaagag

SEQ ID NO: 37 - DNA, 277 bp, Homo sapiens
  misc_feature 191: n = A,T,C or G
ggagagtttggggaagtgtatcgagggaccctgaggctccccagccaggactgcaagactgtggccattaagaccttaaaagacacatccccaggtggccagtggtggaattccttcgagaggcaactatcatgggccagtttagccacccgcatattctgcatctggaaggcgtcgtcacaaagcgaaanccgatcatgatcatcacagaatttatggagaatggagccctggatgccttcctgagggagcgggaggaccagctggtccctgggca

SEQ ID NO: 38 - DNA, 291 bp, Homo sapiens
cggagatcttcaaaaaggagcacccggaccgcttcatcgagtgctacattgctgagcagaacatgcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaatagccgcca

SEQ ID NO: 39 - DNA, 211 bp, Homo sapiens
  misc_feature 85: n = A,T,C or G
tggaggtctaaattacctccagggtttttctgggggtttatcaccagtgtgggtcccttctgataccaccaggttcactccaggncagagtggggcacaaggctgctgaggatatgggtcagttacagcagccctcacctcaaagggctggcctgcttctcagcctacattcatttgcaagcttcaatctctggaccatctggtgttcaca

SEQ ID NO: 40 - DNA, 253 bp, Homo sapiens
caaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagact

SEQ ID NO: 41 - DNA, 271 bp, Homo sapiens
gccaagagctccatatattgggtgtgagttcaggttgcctctcacaatgaaggaagttggtctttgtctgcaggtgggctgctgagggtctgggatctgttttctggaagtgtgcaggtataaacacaccctctgtgcttgtgacaaactggcaggtaccgtgctcattgctaaccactgtctgtccctgaactcccagaaccactacatctggcttgggcaggtctgagataaaacgatctaaaggtaggcagaccctggacccagcctc

SEQ ID NO: 42 - DNA, 249 bp, Homo sapiens
ctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataa

SEQ ID NO: 43 - DNA, 269 bp, Homo sapiens
acacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattcccc

SEQ ID NO: 44 - DNA, 307 bp, Homo sapiens
ggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactga

SEQ ID NO: 45 - DNA, 254 bp, Homo sapiens
atcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactga

SEQ ID NO: 46 - DNA, 254 bp, Homo sapiens
  misc_feature 93: n = A,T,C or G
gttcagtaagggacaaactgtccacccaaggaacagcctggcgatctttttaatgaggactgggactcggagttgaaagcagatcaagggaanccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttga

SEQ ID NO: 47 - DNA, 221 bp, Homo sapiens
aagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgtt

SEQ ID NO: 48 - DNA, 123 bp, Homo sapiens
  misc_feature 18: n = A,T,C or G
ataccatcaatagcattnacctagacagaattcttctggatatccacattttcatgaaggtcttccccaaagagaaactgaagcaatgcaaaagtgaatttcccataaggaccctaaagaccc

SEQ ID NO: 49 - DNA, 248 bp, Homo sapiens
caaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaattggactgcaag

SEQ ID NO: 50 - DNA, 178 bp, Homo sapiens
ggaaataatttaaagatttaagctctggtggatgattatctgctaagtaagtctgaaaatgtaatattttgataatactgtaatacctgtcacacaaatgcttttctaatgttttaaccttgagtattgcagttgctgctttgtacagaggttactgcaataaaggaagtggatcatt

SEQ ID NO: 51 - DNA, 245 bp, Homo sapiens
  misc_feature 65: n = A,T,C or G
atttatattctttgagtgtgagctttgaatagatggcattatcactttattgtttttttaacaanaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatcc

SEQ ID NO: 52 - DNA, 251 bp, Homo sapiens
gtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgt

SEQ ID NO: 53 - DNA, 268 bp, Homo sapiens
ccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactg

SEQ ID NO: 54 - DNA, 248 bp, Homo sapiens
gcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgcctactccaagcccatcaccactgttgtgggagagcccatcaccatccccaagctggagcacca

SEQ ID NO: 55 - DNA, 268 bp, Homo sapiens
  misc_feature 39, 203, 219, 231, 246, 253, 260: n = A,T,C or G
aaaagacatttacaactaggccagggattagccactgtnggagggtggacaggcaatggttcagtggcctggctgttggcaggaactccaagtgcccaggcctcttgggcagcttagggccctgcctctgtttcatgatgcatgggtcattgtcttgggtgtcctatcccatatggagaagaaagggggtctaaattctggcncttctttctttggggntctctgtacctnaggaaaccaggcccngggtgantttgcanatctgctc

SEQ ID NO: 56 - DNA, 168 bp, Homo sapiens
aagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacgg

SEQ ID NO: 57 - DNA, 287 bp, Homo sapiens
gcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaag

SEQ ID NO: 58 - DNA, 256 bp, Homo sapiens
gccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggc

SEQ ID NO: 59 - DNA, 216 bp, Homo sapiens
  misc_feature 120: n = A,T,C or G
atcctgggcgacccagaagccctgagagacctgctgaacaaccacatcttgaagtcagctatgtgtgctgaagccatcgttgcggggctgtctgtagagaccctggagggcacgacactngaggtgggctgcagcggggacatgctcactatcaacgggaaggcgatcatctccaataaagacatcctagccaccaacggggtgatccactacatt

SEQ ID NO: 60 - DNA, 252 bp, Homo sapiens
attacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagtt

SEQ ID NO: 61 - DNA, 262 bp, Homo sapiens
  misc_feature 3, 16, 27, 67, 68, 74, 81, 95, 96, 99, 106, 110, 144, 147,221, 226, 232, 241: n = A,T,C or G
canggttgtacaaaanaattttaatgnattaactcatactgcctgtcttttataggggaaaaaaatnnaccttntttattntaaagttataaggnnttnacctttnagtngcttggatgacagggaattagcctaccccatttnggnctggaacagaagactttcaaatttaatatggtccaagtgtcttcctactcaaggtaaacattatctccaaaatnacatntatgantctaatatntggcattgtgtctgtatctaa

SEQ ID NO: 62 - DNA, 68 bp, Homo sapiens
  misc_feature 3, 26, 27, 51, 52, 53, 58, 60: n = A,T,C or G
ccngcctggtgaaatacatgcactcnnggccggtagttgccatggtctggnnngggcngnatgtggtg

SEQ ID NO: 63 - DNA, 262 bp, Homo sapiens
ggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacg

SEQ ID NO: 64 - DNA, 266 bp, Homo sapiens
tgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctactt

SEQ ID NO: 65 - DNA, 232 bp, Homo sapiens
cggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtgg

SEQ ID NO: 66 - DNA, 238 bp, Homo sapiens
ggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcg

SEQ ID NO: 67 - DNA, 255 bp, Homo sapiens
ctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgaga

SEQ ID NO: 68 - DNA, 259 bp, Homo sapiens
  misc_feature 157, 239: n = A,T,C or G
gaacggcggccgtttcaacttttaaagggagcggtccacggcctccagcgtggggagcgcccgagtcctctcggccacgagctggacgctcttcaggacgtttcaccgccccctcgccccgcacctccagccttcccgactcgcagagtctcccgangccccttttcgcctcgggtttatttattgactgtctttccccctgtcctcgacagaagagtgggaggtgagaagcccgtctnctcagtgagccagcatttca

SEQ ID NO: 69 - DNA, 267 bp, Homo sapiens
cgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgag

SEQ ID NO: 70 - DNA, 256 bp, Homo sapiens
gaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaag

SEQ ID NO: 71 - DNA, 244 bp, Homo sapiens
ggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgc

SEQ ID NO: 72 - DNA, 768 bp, Homo sapiens
  misc_feature 7, 8, 11, 12, 13, 14, 15, 16, 21, 24, 25, 27, 28, 32, 593,668, 713: n = A,T,C or G
tttggannccnnnnnntttgnaanncnncagnctacttgttctttttgcaggatcccatcgattcgaattcggcacgagggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcangtgggctgggcccacccagggagctgatgccccttctcccttctggacacactctcatgtcccttcctgttcttncttctagaaccctgtcgccaccactggtctgtggatgggatcctntcaccttctctaccatccttgggaaggtggggagaaattaggatagacactggct

SEQ ID NO: 73 - DNA, 788 bp, Homo sapiens
  misc_feature 4, 8, 20, 22, 26, 723: n = A,T,C or G
gaanctcngccttttgaccnangcangatccctcgattcgaattcggcacgaggagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatcttaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaaagggccgatgcctgggtttacaaaaagattagtgggaagacatcctatctagcttgcaaggtataaattggatggattcttccatcctgccggatgaattgtgggtgtgattacagcctacttaaagactggtatganccgctttgattttaaagttcattggaactaccaacttggtttcttaagaacctttcttaagaact

SEQ ID NO: 74 - DNA, 701 bp, Homo sapiens
  misc_feature 1, 3, 4, 13, 31, 43, 91, 619, 668, 691: n = A,T,C or G
ncnnaggaaaacnctttgcaaactcttgganccctttgcaggnatcccatcgattcgaattcggcacgagggacagtgtacaaggcccgtnttccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctgccagaatctacagctaccagatggcacttacacccgtggttggtacactctggtacccgagctcccgaagttcttctgcaagtccacatatgcaacacctgtggacatgtggaagtgntggctggatctttgcagagatgtttcgtcgaaagcctctcttctgtggnaacttgaaaccgaccagttggcnaaatctttga

SEQ ID NO: 75 - DNA, 694 bp, Homo sapiens
  misc_feature 4, 7, 11, 21, 27: n = A,T,C or G
gaantcntttncaagctattngatctntttgcaggatcccatcgattcgaattcggcacgaggccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagatggaaaataacggatgggtctcagttacaaataaggacactatggatagtaaaacttgagaagcttttggggtcagatctcttggaacatcatgtgatgaagctgacatttttaaaaatcaaatgatcctttatcttttcagaaattcat

SEQ ID NO: 76 - DNA, 738 bp, Homo sapiens
  misc_feature 2, 3, 4, 5, 6, 7, 8, 9, 10, 11, 12, 13, 17, 20, 21, 23, 24,25, 26, 27, 28, 40, 45: n = A,T,C or G
gnnnnnnnnnnnntttnaanncnnnnnnttttgaatcccntacantctacttgttctttttgcaggatcccatccgattcgaattcggcacgagccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggaatggtgtgaat

SEQ ID NO: 77 - DNA, 244 bp, Homo sapiens
  misc_feature 5, 12, 19, 31, 124, 169, 200: n = A,T,C or G
accgntctcggnggctttnacccagtttggntcttccttgtggtgggaggagtgatgttcattttgggatttgcagggtgcattggagcgctacgggaaaacactttccttctcaagttttttnctgtgttcctgggaattattttcttcctggagctcactgccgganttctagcatttgtcttcaaagactggatcanagaccagctgtatttctttataaacaacaacatcagagcatatc

SEQ ID NO: 78 - DNA, 305 bp, Homo sapiens
  misc_feature 2: n = A,T,C or G
gnccagtggagccccaaaatagaagcaagatgaatattccattccgcattggcaatgccaaaggagatgatgcttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttgggga

SEQ ID NO: 79 - DNA, 260 bp, Homo sapiens
  misc_feature 102: n = A,T,C or G
ttcactttgaatctatctgcaccgtttattagccagttctacaaggaatcattgatgaaagttatgccttatgttgatatactttttggaaatgagacagangctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagt

SEQ ID NO: 80 - DNA, 120 bp, Homo sapiens
  misc_feature 98, 108, 117: n = A,T,C or G
ggggaaaggaggtctcactgagcaccgtcccagcatccggacaccacagcgggcccttcgctccacgcagaaaaaccacactttctcaaacctttcantcaacacttncctttcccnaaa

SEQ ID NO: 81 - DNA, 282 bp, Homo sapiens
  misc_feature 42, 45, 118, 159, 178, 200, 202, 214, 221, 235, 248, 256,259, 265, 270, 280, 281: n = A,T,C or G
atgattatcaaggaagaggaagaagatactgcagagaagccntgnaaggaagaggatgtcgtgactccaaaaccaggcaagagaaagagagaccaggcagaggaggagcccaacagantaccaagccgcagcctccgacggaccaaacttaaccaagantcaacagcccccaaagtgnttttccaggagtggtggatgcncngggaaaacgggnttgtgcntggctctggggggnttctggcggtttngcggcagnggntccccncttgncattattggnnc

SEQ ID NO: 82 - DNA, 231 bp, Homo sapiens
cggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaagtgttacgtgctgacgtgatatac

SEQ ID NO: 83 - DNA, 294 bp, Homo sapiens
agtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaattgacttg

SEQ ID NO: 84 - DNA, 518 bp, Homo sapiens
  misc_feature 2, 3, 4, 5, 6, 11, 14, 18, 26, 27, 49, 50, 59, 97, 104, 110,127, 132, 151, 180, 195, 199, 201, 217, 228, 251, 280, 292,301, 304, 309, 318, 349, 361, 374, 379, 388, 389, 394, 399,409, 420, 423, 435, 436, 441, 459, 465, 474, 482: n = A,T,C or G
  misc_feature 489, 499, 506, 507, 509, 510, 512, 514: n = A,T,C or G
gnnnnntaatnaanaacntttgcctnntaaaccctttttgaaaaccatnnaagctcaangggactacgggaagcagcgggcagcggcccgcggtttncattttngagatntgggtgcaaaagcccanggttnggaaccgtaagcatgctgngccccaaaggtttggcccatgtgctaagncaagccaacactggnggcntncagagcaccctgctgntgaataacganggatcactgctggcctactctgnttacggggacactgacgcccgggtcaccnatgacatagccngttacatcnggnccgantactaccgngaacgggaaccaatcttttaatgaagacaanctcaaattcatnctcatggactgcntgganggccgtgtnnccatnacccnagtggccaancttatgctgtnaanatatgccaaagnnaccgngggctttggaatgctcancgccantgcccaagnttttgtgnactaccnggaggagccncttaaannanncncncccc

SEQ ID NO: 85 - DNA, 515 bp, Homo sapiens
  misc_feature 3, 4, 13, 20, 95, 464: n = A,T,C or G
ttnntttgaaaancatttanctacttgttttttatgcaggatcccatcgattcggacacattggagctggagagcccctcgctgacatccacccnagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaaacctgggctgcggcggagccccatcaagaaagtccggaagtttctggctcttgacattgtggatgaggatgtgaagctgatgatgtncacactgcccaagtctctatccttgccgacaaccctttgggggccccccct

SEQ ID NO: 86 - DNA, 757 bp, Homo sapiens
  misc_feature 1, 469, 577, 619, 643: n = A,T,C or G
ngtatttatcactcttgtctttttgcaggatccctcgattcgaattcggcacgaggtcaaaagctgtcgaaaccgttcacaatttgtgttgcaacgagaacaaaggggcctctgaactagtggcagaattgagcacactttatcagtgtattaggtttccagtgggtagcaatggggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatcccgaaaaaagggttttggggntttctggagaagctggacactgacatttcactcattcgctattttgtcactgaggtgctggacgtcattgctcctccttatacctctgacttcgtgcaacttttcctncccatcctggagaatgacagcatcgcaggtaccatcaaaacngaaggcgagcatgaccctgtgacngagtttatagctcactgcaaatctaacttcatcatggtgaactaatttagagcatccttcagactgaacagaacattccagaacccgttgtggaaaacccttcaagaactgttt

SEQ ID NO: 87 - DNA, 732 bp, Homo sapiens
  misc_feature 1, 3, 10, 12, 17, 19, 24, 344, 359, 417, 428, 429, 468, 543,552, 555, 582, 617, 621, 627, 636, 650, 658, 672, 677, 686,695, 702, 710: n = A,T,C or G
ngncttttanantacananacaanctacttgttctttttgcaggatcccatcgattcgaattccgttgctgtcgcccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtnctgttcctctttctncccgactccaccccagctccctgtgaagagagagttaatatatttgttttatttattngctttttgcgnngggatgggttcgtgtccagtcccgggggtctgatatggncatcacaggctgggtgttcccagcagccctggcttgggggcttgacgcccttcccttgccccaggccatcatctncccactctnctnccctcttcttagtattgccgactgctnttcatctgagtcaccatttactccaagcatgtatnccanacttgncactgactnttcttctggagcangtggctanaaaaaaaagctgtnggcangaaaaaaangctcctgtntctcatntgtgaagncagcctctgggcttttctgccg

SEQ ID NO: 88 - DNA, 541 bp, Homo sapiens
  misc_feature 6: n = A,T,C or G
attatntcagctcttgttctttttgcaggatccctcgattcgaattcggcacgagccgtcacttacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaaggaaaggggccccca

SEQ ID NO: 89 - DNA, 715 bp, Homo sapiens
  misc_feature 22, 30, 86, 249, 463, 471, 562, 568, 573, 631, 682, 690: n = A,T,C or G
tttattccattcacctattcanctacttgntctttttgcaggatcccatcgattcgaattccgttgctgtcggcggctgcagcggncttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagngggcacatttacaaccagaatgtatcccagaaggactgccctgtctctctctgttgtagcaactgcctgcacgtggtggagcccatgccagtgcctggccatgacgtggaggcctactgcctgctgtgcgagtgcaggtcgaggagcgcagcaccaccaccatcaaagtcatcattgtcatctacctgtccgtggtgggtgccctgtttggccntttccccnttcatggccttctgatgctggtggacctctgatccgaaagccggatgcatacactgagcaactgacaatgaggaggagaatgaggccccangagggnagggncccatctgagatctcagaactaagcttcacaacctgcacactgtgtcactctgaatgnaaggaaggtctcagctgacattgggagccagctccagctgggaagatctcnttatgcanactgtgatcctcgggacccacaact

SEQ ID NO: 90 - DNA, 762 bp, Homo sapiens
  misc_feature 1, 617, 713, 717: n = A,T,C or G
nttatcagctcttgttctttttgcaggatcccatcgattcgaattcggcacgaggccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcaacacgttcagcccccaattacgcctgcctnaaccttgcgatgcgccaacataccatcattgacaccagaatgtgagaacgcctacccggcaacatcacagacaccatggtgtgtgccaacgtgcangaanggggcaaggattctggcaggtgacttcggggcccttttggttgta

SEQ ID NO: 91 - DNA, 315 bp, Homo sapiens
  misc_feature 209, 215, 249, 257, 261, 267, 272, 279, 284, 290, 301: n = A,T,C or G
gtcctgcaggccatctacgtgattgacttcttctggaacgaaacctggtacctgaagaccattgacatctgccatgaccacttcgggtggtacctggggctggggcgactgtgtctggctgccttatctttacacgctgcagggtctgtattggtgtaccaccccgtgcagtgtccaacccgcaagccgtggcgtcctgtgcttggctngtgggnaatacatctccgggtggcaaccacaagaagactnttcgcggnagantggccntgctnattgggnagaanccaagntcatcgaggcnctaaaatcgggagg

SEQ ID NO: 92 - DNA, 79 bp, Homo sapiens
  misc_feature 23: n = A,T,C or G
ggaaagatggcgtcccgcaaggnaggtaccggcttctactgccacctctttccagcttccaccggccggcgcagcaggg

SEQ ID NO: 93 - DNA, 831 bp, Homo sapiens
  misc_feature 2, 4, 6, 9, 11, 12, 14, 33, 93, 95, 102, 372, 486, 531, 547,630, 641, 652, 671, 681, 697, 711, 714, 759, 763, 766, 791,796, 829: n = A,T,C or G
tncntnttngnntntaatcccttccccattccnctacttgttctttttgcaggatcccatcgattcgtcactactcagcttttggctctgtgntntagtggnttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcanagtggggactcacagaggcccccagccctgtgccccgctggattgcactttgagcccgtggggtgaggagttggcaatttggagagacaggatttgggggttctgccataatangaggggaaaatcaccccccaccacctcggggaacttcagaccaanggtgagggcgcctttncctcaagactgggtgtgaccagaggaaaaggaagtgcccaacatcttccaaccttcccaagtgcccccctcaccttgatgggngcgttcccgcngaccaaaaaanagtgtgacttcccttgccngcttccaaantgggggggggcttgtncccagggggcaaanaangggtgttaagggccccatgaccaaaaacaattggggtttggtggncccnaanttggtggttgtcaccaccaaacttnaatanttttttttcccttgtaaatgccccttcccccantg

SEQ ID NO: 94 - DNA, 806 bp, Homo sapiens
  misc_feature 2, 3, 6, 11, 13, 14, 22, 26, 29, 30, 32, 36, 81, 88, 99,107, 123, 130, 141, 148, 214, 216, 375, 420, 445, 447, 452,486, 506, 534, 559, 627, 633, 636, 662, 666, 685, 686, 692,698, 699, 721, 724, 749, 777: n = A,T,C or G
annttnattgnanngaaatccnttcnacnngncccnttgcaggatccctcgattcgaattcggcacgagcccaccatcacngaggccntggtagcacgntttcgganaagccatccctgcctnagaagcngagcaggctgnggagcangaagcttcctgacatgggctgcagtcttcctgagcacagggcacaccaagaagcaagccataggcngntctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaanaggtaaggctctccaaagagatggagcgaccctgggttaggcagncttctgccccagagaaacactccananactgntacaaggaggaagaacacctcactcagtcaatcntcccaccccctaaaccaganaggagtcatagcctgaaactccatcatncccagaacgtggagagggaccccantgtgctgtaccagtaccaaccacacggcaagcgccagagcagtgtgactgttgtgtcccagtatgatnacctgnaanattaccacttgctgcctcagcaccancgangagtcttttggagggggcnngtatgngggacnntttgtgccccccttgggttttnccnattcacaaaaagcaaggaccttatnctttcagcgttgggtcaagggggctttnctgccccccaaaatttttccttgcacatt

SEQ ID NO: 95 - DNA, 314 bp, Homo sapiens
cggacggtggggaaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaa

SEQ ID NO: 96 - DNA, 255 bp, Homo sapiens
ccacaacctgctcatgggtgacaccaaggagcagcgcatcctgaaccatgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtc

SEQ ID NO: 97 - DNA, 261 bp, Homo sapiens
ccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggagg

SEQ ID NO: 98 - DNA, 734 bp, Homo sapiens
  misc_feature 651, 706, 708, 722, 727: n = A,T,C or G
ttttcttcaactacttgttctttttgcaggatcccatcgattcgaattccgttgctgtcgaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcaaaaggacacagcccgtcctcccctgcctgcctgattccatggctgttgtgctgattccaatgctttcacgttggttcctggcgtgggaactgctcttctttgcagccccatttccaagctctgttcaagttaaacttatgtnagctttccgtggcattgcggggcgcgcaccccgttcccgctgcgtaagactcttntntttggatgccaatncacangcctgaa

SEQ ID NO: 99 - DNA, 736 bp, Homo sapiens
  misc_feature 5, 11, 16, 22, 198, 241, 466, 470, 506, 590, 612, 626, 632,662, 673, 694, 705: n = A,T,C or G
agtcnttgganttcanatacangctacttgttctttttgcaggatcccatcgattcgaattccgttgctgtcggctggcgtcaagagcagttgactcactgatgaaggccctggtgaggagaaagcactctgttcttcgcctactctgtaatcgttttgtcataatgagccatgaaaaaagtaatgaacttgtgctgntaatcgtcactgtaatgagaagtcttacgtacaacatagctgnggtggctgcgtggtttaatggctgcattagataggatcctcacatcccattcagaaccaaaactgatacagtgaaacaattaaggtgagcaaatagttttaacctttctttttttttttttaagtttcattcttcctagaatatttttctaacaatttttatttcagctttaaagatgggtcatatagccaaacgggccatataatccaacattgttgagatgtnttangacatctaaggcaaaactggcacatttgttctgcanactattgcaggaatgttttttcctagcatttctatattatctgtccattctgaggaaccagtgaatgtcctataaatgcacctnctgtcaaaaccatgcctgatangtcccggctgggantgacanggtgcttcttaaattctattggcccttctntcattctccgnacttactcctttttatgggtnaggtcaaatanggttacagtcccttttttttaatgcctaagt

SEQ ID NO: 100 - DNA, 732 bp, Homo sapiens
  misc_feature 2, 3, 7, 12, 13, 16, 18, 37, 75, 328, 365, 394, 427, 442,447, 448, 451, 455, 462, 479, 515, 517, 529, 531, 540, 614,643, 649, 667, 699, 716, 721, 725, 731: n = A,T,C or G
tnncatntaganntcnanctacttgttctttttgcangatcccatcgattcgaattccgttgctgtcgccggctngagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtangaccatgcactcacacccatctggagagggagccccnggtataccaagggagccagttgtgttcanacacacacatcacagcttgactcactaactgangcctttccatagctncacannttnccanctcctcnccaccaaaccggggttntagagttaaggatgggggagggtattatactgcctnantctgacttctcnanccaacaatnaattttaggggatgatggggaagaagagctgcctttaggaggccctcttcacctgcagctatgatgcccttccnttttccttgtcctcaccatatgcttatcnccattntactcccatgttatgctngagcccctgtggcttgttcacaagccctaagnaacaaaaatcatctggngaaanaagnatttant

SEQ ID NO: 101 - DNA, 706 bp, Homo sapiens
  misc_feature 2, 7, 28, 36, 129, 167, 178, 245, 349, 412, 467, 527, 573,588, 628: n = A,T,C or G
tngattngatacagctctagtctatacncgctactngttctttttgcaggatcccatcgattcgaattccgttgctgtcgagcaaaaccatactccaagaaagcatcatcaacatcaccaccagcagcngcaccaccagcagcaacagcagcagccgccaccaccgncaatacctgcnaatgggcaacaggccagcagccaaaatgaaggcttgactattgacctgaagaattttagaaaaccangagagaagaccttcacccaacgaagccgctttttgtgggaaatcttcctcccgacatcactgaggaagaaatgaggaaactatttgagaaatatggaaaggcangcgaagtcttcattcataaggataaaggatttggctttatccgcttggaaacccgaaccctancggagattgccaaagtggagctggacaatatgccactccgtggaaagcagctgcntgtgcgctttgcctgccatagtgcatcccttacagttcgaaaccttcctcagtatgtgtncaacgaactgctggaagaagccttttctgtgtttggccatgtaganagggctgtagtcatngtggatgatcgaggaaggccctcaggaaaaggcattggtnagttctcaagggaagccacttgctcggaaaaagctctggacagatgcagtgaaagcttcttttctggttaaccacatt

SEQ ID NO: 102 - DNA, 924 bp, Homo sapiens
  misc_feature 2, 3, 4, 5, 6, 8, 9, 10, 11, 13, 14, 15, 16, 17, 18, 19,21, 22, 23, 24, 25, 26, 27, 28, 29, 30, 31, 32, 33, 34,35, 36, 37, 38, 39, 40, 41, 42, 43, 44, 45, 46, 47, 48,49, 50, 51, 52, 53, 54, 55, 56, 57, 58, 61, 62, 65, 67,68, 69: n = A,T,C or G
  misc_feature 70, 71, 72, 73, 74, 75, 76, 77, 78, 79, 85, 86, 87, 88, 89,91, 92, 93, 95, 96, 97, 98, 99, 100, 101, 103, 105, 106,107, 108, 109, 110, 111, 112, 113, 114, 115, 116, 117, 118,119, 120, 121, 122, 123, 134, 141, 149, 166, 311, 354: n = A,T,C or G
  misc_feature 369, 411, 423, 438, 450, 461, 462, 471, 523, 538, 554, 565,594, 595, 618, 619, 626, 631, 637, 640, 641, 642, 654, 689,706, 732, 740, 759, 772, 794, 797, 801, 804, 815, 816, 820,830, 838, 839, 858, 875, 890, 893, 901, 905, 906, 916: n = A,T,C or G
  misc_feature 919, 922, 924: n = A,T,C or G
annnnnannnngnnnnnnnannnnnnnnnnnnnnnnnnnnnnnnnnnnnnnnnnnnnnacnnacngnnnnnnnnnnnnngggggnnnnncnnncnnnnnnnancnnnnnnnnnnnnnnnnnnncgagcggtttntttgtancaacctcncaaactacctgggttcnttttgcaaggaacccatcgattcgaattccgttgctgtcgagccagccaggcctgtcgtctgggacccaggaggcctctgatgaccaagggctttcacatcctaagtcatttggaaggaggccttgagaacaaagtcacctttgncactcccagtgaactgaatgaggaacatgctggctcctgtctnggcctcccctttcangagatactggggagaagagaacattcctcctggcttaggtgnagcaagacccangacctggtgcccagntttggtcccccntcccaacttcnnaaagcacgnggctgcagagccaccttggtctgagccacctgagggaccaagccccctcctncctcagaaggcgggncatctcttaggggganattcttaaagntgaaaaaaaggggggggggggaaccatanntgcccctccctccccatcaaaannttccttncattnaacttngcnnnaaaatgagtcantataaagaaaactctatttgggtggaggggatatnccacttctggggaaaancattacaaattcaaacccgcttctcntcagtttnattttaagaatgctttttngttgcagaaccgnggagctcctaaaagtggaaagnccncccnagnggtgtggtggnngaanaaaaaaaaanaccttggnnaacctccatttacaggctngggcccttatcttaacnattaaacccaagganccngaagcccnggcnngggaatttgnctnaancn

SEQ ID NO: 103 - DNA, 511 bp, Homo sapiens
  misc_feature 2, 3, 4, 5, 6, 7, 8, 9, 10, 15, 21, 28, 182, 417, 500: n = A,T,C or G
gnnnnnnnnnttttnaatttncatacangctacttgttctttttgcaggatcccatcgattccgaattccgttgctgtcgatcctgggccacccctacgacgtggccattgacatgtggagcctgggctgcatcacggcggagttgtacacgggctaccccctgttccccggggagaatgangtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttngcatgaccccggaccaggccctcaagcatgcttggattcatcagtctcggaacctcaaaagggccccaaccagggcccccccnaagggcccccc

SEQ ID NO: 104 - DNA, 715 bp, Homo sapiens
  misc_feature 2, 3, 4, 7, 10, 15, 21, 626: n = A,T,C or G
gnnnttnaantatanatacanctacttgttctttttgcaggatcccatcgattcgaattccgttgctgtcgctcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcatgtaattcttaaggagctccgaaaagcaagaaatcaaataacacagttggaatccttgaaacagcttcatgagtttgccatcacagagccattagtcactttccaaggagagactgaaaacagagaaaaagttgccgcctcaccaaaaagtcccactgctgcactcaatgaaagcctggtggaatgtnccaagtgcaatatacagtatccagccactgagcatcgcgatctgcttgtccatgtggaatactggtcaaagtacaaaataagtatttgt

SEQ ID NO: 105 - DNA, 715 bp, Homo sapiens
  misc_feature 17, 82, 97, 685, 699, 709, 712: n = A,T,C or G
tttttttaaaatacatncaactacttgttctttttgcaggatcccatcgattcgaattccgttgctgtcgagcatgaccaancagctgggtgacttntggacacggatggaggactccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaacgtgtggagcagatccgtgaccacatcaatgggcgcgtgctctactatgccacctgcaagtgatgctacagcttccacccgttgccccactcatctgccgctttgcttttggttgggggcagattgggttggaatgctttccatcttcaggagactttcatgtagcctaaagtacagcctggaccacccctggtgtgtacttagtaaaaataccctgaacttgcaacttaaccttgacccaatgggacaantacactttgacaanacaaaagatngtngga

SEQ ID NO: 106 - DNA, 728 bp, Homo sapiens
  misc_feature 9, 20, 25, 450, 476, 486, 543, 557, 568, 589, 592, 606, 672,721: n = A,T,C or G
tggcttttnaaaacccttanacaanctacttgttctttttgcaggatcccatcgattcgaattccgttgctgtcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgngggaagatttggagaacacactgaangccttgcctnctgcccaggagcctgacgaaattctctatgtcaacatggatgagggtggaggttatncttgaaccccctgnacttgcaggangactgacccccccaacccaancanaccctaagggattnctgtacttgcctcacttgcgggctgaggtccatcctggttggacgcttttgtccttttgccctttncaacaaccccttaaccccgcttaaacctgtttataaggggcttccccancagccct

SEQ ID NO: 107 - DNA, 656 bp, Homo sapiens
  misc_feature 2, 11, 12, 13, 18, 122, 130: n = A,T,C or G
gncttttgaannnccttnaccactacttgtgtctttttgcaggatcccatcgattcgaattccgttgctgtcggactatgatgccaactttaaaataaaggacttccctgaaaaactaaggntatctttnttgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctc

SEQ ID NO: 108 - DNA, 880 bp, Homo sapiens
  misc_feature 2, 9, 14, 190, 236, 476, 486, 516, 535, 544, 572, 580, 608,615, 621, 647, 677, 720, 724, 759, 793, 811, 830, 842, 846,863, 866, 870, 878: n = A,T,C or G
tnttattanatcanctcttgtctttttgcaggatccctcgattcgaattcggcacgaggccggctccagggccatgaagcccccaggaggagaatcgagcaatctttttggaagtccagaagaagctactccttccagcaggcctaataggatggcatctaatatttttggaccaacagaagaacctcanaacatacccaagaggacaaatcccccagggggtaaaggaagcggtntctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagaccaggtgagaaaggcagcgccagaaaagcaggccccgncaaggagcangaacccatgcccacagtctacagccatganccccggctggggccgcggnctcgctctnacaacaaggtcctgaaccccaccgggangcaaaatncagcatcttccttctacttaagagaaanccactgnttcaancccggagcccagacccagaaaacttnaaagaagaataggggtaagcccatggtttntcaaattttcccttttgggccccaaaatggaacccgggggttngggnaaaaaaaggggtttaagtcccttaattgttgaaancccttgggcttcgctccatctctctctcttcttngcctctctcccattgganccctcctttgccttttggnaaacaacccccnttgnccctttcccaaaaattnggncttnggccaaanat

SEQ ID NO: 109 - DNA, 668 bp, Homo sapiens
  misc_feature 3, 8, 9, 10, 12, 14, 17, 25, 537, 560, 582, 585, 604, 609,622, 631, 644: n = A,T,C or G
cgnttaannncntnatntacatcanctacttgttctttttgcaggatcccatcgattcgcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaacgccttccgtcggcgttgttttaaaatgggaagcctcgaccctgtattgaaactgagctgttcgaaggcggcgttgtgtgcaattccgattaatgaaggggaagggttttgtgtggaaaaacnccttggagtgtgacatttctgcnagaatgcttaaataccgatttnccncaggaacaatggcgctgtnttcantggcacagtggancagctctgnagatgcaaagatnccccaaaaaaaaaaaccttttttt

SEQ ID NO: 110 - DNA, 276 bp, Homo sapiens
  misc_feature 14: n = A,T,C or G
gtcagagctgcctncgatttggtaaaatgtgctgcgagaagtggagccgcgtggcggcaaatgtttctcttcactgaggagcgggaggattgtaagatactgtgcctttgctccagggcatttgtggaggatcgaaaattgtacaatttgggattaaaaggctattacatcagagacagtggcaacaattcaggagaccaggcgacagaagaagaggaaggtggttattcctgtggtactgcagaatcacatgacagcaaaggcataggcctggct

SEQ ID NO: 111 - DNA, 701 bp, Homo sapiens
  misc_feature 3, 8, 12, 13, 14, 251, 269, 280, 378, 381, 413, 454, 496,547, 584, 598, 600, 636, 651, 659, 692, 695: n = A,T,C or G
ttnatccntttnnnatacaagctacttgttctttttgcaggatcccatcgattcgaattcggcacgaggagaaactcaaaagtaggaagctcctccttcctggagaactgtcacagtgacttcaggtcaccaaagggaggaggtacagaaagatgctggtgtatgtgacgaggctggtggccactgaagcaccacagtgcagtgggaagaaacaaggagagacaagctgggtccccacctaggaaacagangtgtggcaaccgggccanggctggcacangctgggggccaaggggaggagctccctgacgaccagtgcttttcggggcctcggtggtggttgcaagaaattgcctaccaaaacttcacccactgcancangccaagttgcacccgggaagccgaggaagaangtgagactcccccctttgcaggggtcttgactgagtacttnccaccatagcagtgggatacgcatgctggttgtaattgtagntctgatcggctctgctgcacgtttctgcagtgatgacgcgtccgcaccctnaataattgctttccagttgaagaaaggaatgttctgnttgaaatcctccanantcggctgaataaaagaggctcgggtgctggggggcnggacctggttcttgntatgcatnccattgatgaaacccacttggattaaaatcttncanaaaggg

SEQ ID NO: 112 - DNA, 227 bp, Homo sapiens
  misc_feature 94, 102, 152, 154, 199, 214: n = A,T,C or G
gccaaggagtggcaggccctctgtgcctaccaagcagagccaaacaactgtgccaccgcgcagggggagggcaacatcaaaaagaaccggcatnctgacttnctgccctatgaccatgcccgcataaaactgaaggtggagagcagcccttntnggagcgattacattaacggcagccccattattgagcatgaccctnggatgccagctacgnaggcaaggagggt

SEQ ID NO: 113 - DNA, 243 bp, Homo sapiens
agaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggagg

SEQ ID NO: 114 - DNA, 310 bp, Homo sapiens
  misc_feature 232, 240, 258, 300: n = A,T,C or G
taagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggntccttggntcgtttccgcaacatctntcgcattatgcgagtcaacaacagtaccatgctgggtgcctntggcgactac

SEQ ID NO: 115 - DNA, 706 bp, Homo sapiens
  misc_feature 1, 4, 573, 642, 655, 691, 701: n = A,T,C or G
nttnagatacaagctacttgttctttttgcaggatcccatcgattcgaattcggcacgagggaacctctatgctggggactattaccgtgtgcagggcccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctcctcagggagcgatccaggggaagccagtgacactaaaacaagaggacacaatggcacctctgcccttccctcccgacagcccatcacctctaatagaggcagtgagactgcangtgggctgggcccacccagggagctgatgccccttctccccttcctggacacactctcatgtccccttnctgttcttccttnctaaaacccctgtcgccaccactggtcctgtggatnggatcttttncacct

SEQ ID NO: 116 - DNA, 731 bp, Homo sapiens
  misc_feature 2, 3, 10, 82, 94, 157, 191, 198, 369, 493, 538, 545, 578,581, 672, 678, 700: n = A,T,C or G
tnntttaganacagctcttgttctttttgcaggatcccatcgattcgaattcggcacgaggagtaaatactcactacgccanatcgttacactncaccctcaaaagctagaaaccagtgcctgaaagaaactccaattaaaataccagtaaattcancaggaacagacaagttaatgacaggtgtcattanccctganaggcggtgccgctcagtggaattggatcttaaccaagcacatatggaggagactccaaaaagaaagggagccaaagtgtttgggagccttgaaagggggttggataaggttatcactgtgctcaccaggagcaaaaggaagggttctgccagagacgggcccagaagactnaagcttcactataatgtgactacaactagattagtgaatccagatcaactgttgaatgaaataatgtctattcttccaaagaagcatgttgactttgtacaaaagggttatacactgaagtgtnaaacacagtcagattttgggaaagtgacaatgcaatttgaattanaagtgtncccacttcaaaaacccgatgtggtgggtatcangangcaacggcttaagggcgatgcctgggtttacaaaagattagtggaagacatcctatctagctgcaaggtataattgatggattcttccatnctgccngatgaatgtgggtgtgatacancctacataaaaactgttatgatcgcttttga

SEQ ID NO: 117 - DNA, 821 bp, Homo sapiens
  misc_feature 4, 6, 9, 14, 15, 17, 22, 59, 68, 118, 142, 165, 194, 208,231, 270, 283, 291, 314, 321, 421, 442, 457, 509, 542, 544,547, 548, 607, 614, 627, 635, 640, 671, 688, 712, 743, 762,789, 803: n = A,T,C or G
tttnanttntaccnntntcgantccgtgctgtcggaaagtggtactaccagatagaaantctgaaatnggaaattggaggccaaagccttaatctggactgcagagagtataacgcanacaaggccatcgtggacagtggcnccacgctgctgcgcctgccccanaaggtgtttgatgcggtggtggaagctgnggcccgcgcatctntgattccagaattctctgatggnttctggactgggtcccagctggcgtgctggacgaattcngaaacaccttggncttacttncctaaaatctccatctacctganagatganaactccagcaggtcattccgtatcacaatcctgcctcagctttacattcacccatgatgggggccggcctgaattatgaatgttaccgattcggcatttncccatccacaaatgcgctggngatcggtgccacggngatggagggcttctacgtcatcttcgacagacccataagaaggtgggctttnaacgaacccctgtgcaaaaattgcaagtgctgnantgnntgaaatttccgggcctttctcaacagaagatgtaaccagcaactgtgtccccctcaatnttttganccgacccaatttngggggatnggggncctatgcccctcatgaaccgtttgttggagnccatccctcctttgtcnttaaatcggcccttgcttgcttgntggccgtttcccggtggttaagcggtaaagnccccgtggaaccttgaggnccgtccaatggatgaaattcctctctnggacaaaaaatttncttgggaaattgaattac

SEQ ID NO: 118 - DNA, 898 bp, Homo sapiens
  misc_feature 4, 5, 17, 131, 138, 263, 371, 391, 417, 424, 438, 478, 518,525, 529, 554, 562, 568, 587, 589, 592, 604, 612, 615, 623,624, 645, 646, 647, 680, 683, 685, 687, 688, 693, 694, 710,714, 719, 733, 743, 751, 759, 760, 771, 772, 773, 781: n = A,T,C or G
  misc_feature 782, 788, 790, 791, 792, 798, 803, 804, 811, 830, 834, 835,842, 846, 848, 853, 854, 873, 878, 889: n = A,T,C or G
gtcnncttgaaaccttnaacacttccgttgctgtcggtcctaatgtgtcagcagcaaatccccgaggtgtcttcatgatgtgcatcccaccccccaatgtgacaggctccctgcacctgggccatgcactnaccaacnccatccaggactccctgactcgatggcaccgcatgcgtggggagaccaccctgtggaaccctggctgtgaccatgcaggtattgccacccaggtggtggtggagaagaagctatggcgtgagcanggactgagccggcaccagctgggccgcgaggcctttctacaggaagtctggaagtggaaggaggagaaaggtgaccggatttaccaccagttgaagaagctttggcangctccttggactggggatcnagcctgtttcaccatggaccctaaanctctcancaggctgttgacanaagcctttgtccggcttcacgaggaaaggcaatcatctantcgcaatacccgccttgttaactggttctgcaccctcaanttccggncatnttttgacatttgaaggtgggataanaaaggaancttganaagggtccgcaacccttgntnttncgttgccttggnctaccaanggnagaaaggnngggaagttctggggttccttnnntgttccttttgcccttattaaaggttcccaaangtntntnngaatnnccctaacaaatggaangttngttgngttgggccaaacanacttcgggtntcggaagnaaaaattnnttgggaagaannntgggcttnntacctntnnncctctntaaannaatactngtaatcccaaccatccttncaanngggaaangaantnggatnncaaccaattcctggtttcngaaanctttcccattngttttggat

SEQ ID NO: 119 - DNA, 244 bp, Homo sapiens
gccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggaca

SEQ ID NO: 120 - DNA, 247 bp, Homo sapiens
  misc_feature 178, 207, 212, 246: n = A,T,C or G
atacatgcaaatgccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgtggcacagggcaaanctgacttcctttggggctcagtttccctnccttnatgaaatgaaaagatactactttttcttgttggnt

SEQ ID NO: 121 - DNA, 303 bp, Homo sapiens
gtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcac

SEQ ID NO: 122 - DNA, 297 bp, Homo sapiens
  misc_feature 261: n = A,T,C or G
gcaggtggtggaaaagcagaaccttagcaaagaggagctgatagcggagtgcaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggttcgntgaaggacggcaaatgggagcggaagaagttcatgg

SEQ ID NO: 123 - DNA, 750 bp, Homo sapiens
  misc_feature 4, 601, 632, 697, 708, 717: n = A,T,C or G
tcgntcgattcggccgaggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttgggttaaaagatggttgtagcatttaaaatggaaaattttctccttggtttgctagtatcttgggtgtattctctgtaagtgtagctcaaataggtcatcatgaaagggtaaaaaagcgangtggccatgttatgctggtggttaaagccanggcctctccaaccactgtgccactgacttgctgtgtgaccctggcaagtcacttaactataaggngccccaatttncttctgttnaaatgggggataataatacctgacctacctcaa

SEQ ID NO: 124 - DNA, 756 bp, Homo sapiens
  misc_feature 18, 651, 727: n = A,T,C or G
tttttaaccccattcgantcgcacgaggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttgggttaaaagatggttgtagcatttaaaatggaaaattttctccttggtttgctagtatcttgggtgtattctctgtaagtgtagctcaaataggtcatcatgaaagggtaaaaaagcgaggtggccatgttatgctggtggttaaagccagggcctcttcnaccactgtgccactgacttgctgtgtgaccctgggcaagtcacttaactataagggccccaattttccttctgttnaaaaggggataataatactgcctacctcg

SEQ ID NO: 125 - DNA, 793 bp, Homo sapiens
  misc_feature 2, 3, 4, 5, 6, 10, 11, 12, 13, 25, 30, 631, 735, 763, 783: n = A,T,C or G
gnnnnntttnnnnttttgaacccgnttgantccgttgctgtcgacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctaaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgnaattttattttaatgtattttgatttatgattatttattagtttttttttaaatgcttggttctaagaacatttttggaatgtagaccattttttccaaaaaanggaaacttttatttttcaaaaaaacctnaatcccgggaggtaaatttnccttaatctt

SEQ ID NO: 126 - DNA, 769 bp, Homo sapiens
  misc_feature 11, 78, 675, 750, 763: n = A,T,C or G
ttgaaacccgntcgattccgtgctgtcgacctggtccagcagcagcccccctcgcagccgcagccgcagccgcagctncagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctaaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttttaaatgctnggtctaagacattttttgaatgtaggaccattttccaaaaaggaaacttttattttttcaaaaaccttaatccgnaagtaaattcctnaatctt

SEQ ID NO: 127 - DNA, 752 bp, Homo sapiens
  misc_feature 6, 10, 557, 628, 632, 634, 662, 669, 672, 703, 707, 720,737, 738, 741: n = A,T,C or G
cctcgntcgntcggcacgaggaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcancctctgggatggattactggattgttaaaaacaagctggggcacccgctggggtgagaatggctactttcngatncncaaaagaactgatgagtgtgcaattganagcatancantggcagcccaccaatttctaaattgtagggnatgncttccaatatttnataatgatctggatcanntgnaaaaggggaat

SEQ ID NO: 128 - DNA, 754 bp, Homo sapiens
  misc_feature 4, 8, 556, 626, 634, 661, 676, 688, 697, 703, 715, 737, 744,754: n = A,T,C or G
tcgntcgnttcggcacgaggaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcancctctgggatggattactggattgttaaaaacagctggggcacccgctggggtgagaatggctactttcngatcccanaagaactgatgagtgtgcaattgaaancataacaatggcagncacacccaattnctaaattgnaagggnattgccttccanatttcataatgatctgcatcantgtaaangggaattggn

SEQ ID NO: 129 - DNA, 780 bp, Homo sapiens
  misc_feature 2, 3, 4, 5, 6, 7, 8, 9, 10, 11, 12, 16, 769: n = A,T,C or G
gnnnnnnnnnnntttntacctcgttcgatttccgttgctgtcggaaaacccccactgatgaacctgaaaaggctgtggaggatattaatgaacatattacccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaccaagccattaacagttcanagaacataatg

SEQ ID NO: 130 - DNA, 773 bp, Homo sapiens
  misc_feature 2, 5, 754: n = A,T,C or G
cnccnttcgaattcggcacgagcccggcccctgcagtccggatactcacgccagaaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgacctctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgctgaagcccgacacggtgccaagcgccctgctgcgtgcccgccagctacaatcccatggtgctcattcaaaagaccgacaccggggtgtcgctccaaaacctatgatgacttgttagccaaaagactgccacttgcatatgaacaagtcctggtcccttcacttgtgcaccttgcgccgggggangcgaacctcagttgtcctt

SEQ ID NO: 131 - DNA, 300 bp, Homo sapiens
  misc_feature 54: n = A,T,C or G
gccagacaagcctgactctgaggagcaagccaagatagcaaagcttggacttangctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaa

SEQ ID NO: 132 - DNA, 263 bp, Homo sapiens
cccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactttggagtaaaa

SEQ ID NO: 133 - DNA, 300 bp, Homo sapiens
actccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctattttttttcaataaccaaaaagattaaacaaaaaatactataaaacccctgaccacatttaaaaaatgata

SEQ ID NO: 134 - DNA, 300 bp, Homo sapiens
aagacaagatccatgatggctctcttagtccaacttctttcactttgttataaactgctgaagaagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataa

SEQ ID NO: 135 - DNA, 300 bp, Homo sapiens
ctgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttaca

SEQ ID NO: 136 - DNA, 300 bp, Homo sapiens
  misc_feature 27, 37, 39, 80: n = A,T,C or G
gactccctatacaagctcttgggattnctgcaggatncnatcgattcgtcactactcagcttttggctctgtgggcgagnggcttcgggccatcaaaatgggaagatacgaagaaagcttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactg

SEQ ID NO: 137 - DNA, 262 bp, Homo sapiens
  misc_feature 221, 222, 233, 236, 239, 245, 246, 250, 251, 252, 253, 254,255, 256, 258, 259: n = A,T,C or G
ggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcnntattgtatggngangantgtgtnntctnnnnnnnanngtt

SEQ ID NO: 138 - DNA, 300 bp, Homo sapiens
aattccgttgctgtcgcacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggatggacagattcctggtgaaaggggctcaagggggccttttgaggaagcaggaggagcaagagccaac

SEQ ID NO: 139 - DNA, 300 bp, Homo sapiens
ggtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacc

SEQ ID NO: 140 - DNA, 358 bp, Homo sapiens
gagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttac

SEQ ID NO: 141 - DNA, 365 bp, Homo sapiens
ggggtttcaccatgttggccaggctggtctcaaactcctgacctcaggtgatccacccacctctgtctcccaaagtgctgggattacaggagtgtgccactgcgcctgaccagctttataaagtttatagggacagtgtcaccactttacagaagagggactgaggctctgaggaggaagttccttgccagggtccgagtgtcgccaccctgagaactccaacacccacctccctactctgctcatggcgtctcccccacctttccacagccagaagttgccaggtgaatacttccggtacaagggcgtccccttcccgtcggcctgtactcgctcgagagcatcaacttggcggagaacaccca

SEQ ID NO: 142 - DNA, 405 bp, Homo sapiens
  misc_feature 390: n = A,T,C or G
gccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccaagtcatgtgttaagttgcgcttctttgctgtgatgtgggtggggnagaagaagtaaaaca

SEQ ID NO: 143 - DNA, 377 bp, Homo sapiens
  misc_feature 332: n = A,T,C or G
cccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgntttatttatttgctttttgcgttgggatgggttcgtgtccagtcc

SEQ ID NO: 144 - DNA, 391 bp, Homo sapiens
ccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactggctcaattcccctacatagttcacctggggcagcacaacctccagaaggaggagggctgtgagcagacccggacagccactgagtccttccccaccccggcttcaacaacagcctc

SEQ ID NO: 145 - DNA, 388 bp, Homo sapiens
ggcacgagagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatg

SEQ ID NO: 146 - DNA, 366 bp, Homo sapiens
  misc_feature 366: n = A,T,C or G
tacggctgcgagaagacgacagaagggtggttatctctgggtaacgagggttaaaagctatgttcattttcctcttctatctgcattttttaaattttctataaagatcatgaattttgtcatttcaaaagttaacaaaggctgggcgcgggggctcacgcctgtaatcccagcactttgggaggccgaggcggccggatcacaaggtcaggagatcgagaccatcttgtctaacacggtgaaaccccgtttctactaaaaatacacaaaattagccggccgccgttgcgatctcttgtaatttccaaaactcgggatgcttaagctttataattcggggcacttgtttgtccgcccttcaatttn

SEQ ID NO: 147 - DNA, 354 bp, Homo sapiens
  misc_feature 354: n = A,T,C or G
tacggctgcgagaagacgacagaagggggctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtggccaccacaagatgtgccctgatggcn

SEQ ID NO: 148 - DNA, 351 bp, Homo sapiens
  misc_feature 351: n = A,T,C or G
tacggctgcgagaagacgacagaagggagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcn

SEQ ID NO: 149 - DNA, 414 bp, Homo sapiens
tacggctgcgagaagacgacagaaggggagagtcactcctgccttcaccatgaagtccagcggcctcttccccttcctggagctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtg

SEQ ID NO: 150 - DNA, 380 bp, Homo sapiens
tacggttgcgagattacgacagaaggggggaggttggcgaggctttgctgaaagctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgata

SEQ ID NO: 151 - DNA, 396 bp, Homo sapiens
tacggctgcgagaagacgacagaaggggagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcct

SEQ ID NO: 152 - DNA, 336 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggctgtaatccctgcactttgggaggctgaggcaggcggatcacctgaagccaggagttcaaaatcagcctgaccaacatggagaaaccccatctctactaaaaatacaaaattagccgggcatggtggtggcgcatgcctgtaatcccagctactcgggaagctgaggcaggagaatcacttgaacctgggatgtggaggct

SEQ ID NO: 153 - DNA, 340 bp, Homo sapiens
  misc_feature 340: n = A,T,C or G
tacggttgcgagaagacgacagaagggtacggctgcgagaagacgacagaagggtacggctgcgagaagacgacagaagggtacggctgcgagaagacgacagaagggtacggctgcgagaagacgacagaagggctgtaatccctgcactttgggaggctgaggcaggcggatcacctgaagccaggagttcaaaatcagcctgaccaacatggagaaaccccatctctactaaaaatacaaaattagccgggcatggtggtggcgcatgcctgtaatcccagctactcgggaagctgaggcaggagaatcacttgaacctgggatgtggaggttgcgn

SEQ ID NO: 154 - DNA, 339 bp, Homo sapiens
tacggctgcgagaagacgacagaagggaacaatgcatgatgctgttttgcatattttgatgaagaaagattacagtacttcaaagtttaatcccagtcaggaaaaagatggaaaaattgattttaccataaatacaaatggaggattacgtaatcgggtatatgaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatgggtctagcatggc

SEQ ID NO: 155 - DNA, 403 bp, Homo sapiens
tacggctgcgagaagacgacagaaggggagttgcagtcgggttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacc

SEQ ID NO: 156 - DNA, 396 bp, Homo sapiens
tacggctgcgagaagacgacagaaggggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagct

SEQ ID NO: 157 - DNA, 362 bp, Homo sapiens
tacggctgcgagaagacgacagaagggatatcaatgtttgcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttggtgggttgcttttaaattagtttatttctaaatcttagtcttccacatttctagaggccacctgacacaagtccctgtatctgaagtctagcatctcaaggctgatctggaagagcgctagaatgctccctagcggataacttagtct

SEQ ID NO: 158 - DNA, 379 bp, Homo sapiens
tacggctgcgagaagacgacagaagggagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccatgcaacactccttccaaatggccatcccagcatgcttccaagcaggcttcatccg

SEQ ID NO: 159 - DNA, 384 bp, Homo sapiens
  misc_feature 384: n = A,T,C or G
tacggctgcgagaagacgacagaaggggagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattgtggcctagctatggcttgccatgactccttcctcaaggctggcccttn

SEQ ID NO: 160 - DNA, 391 bp, Homo sapiens
  misc_feature 77, 391: n = A,T,C or G
tacggttgcgagaagacgacagaacggtaccgctgggagaggaccacagaagggggcttccgggtcgtacgcgctanctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagagggtcgtaaccgtgacttcacgagagagttggaagaaagagagagagctgctgcaagagaan

SEQ ID NO: 161 - DNA, 389 bp, Homo sapiens
tacggctgcgagaagacgacagaagggcaagaaaacttacgaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgccatccccactttagtcacgagatctttttctgctaactgttcatagcctgtgtagggcccatgggttcttcatgggctatgatctctgaaaagacgttatcaccttaaagctcaaattctttgggagggtttttacttaagcccattaccaattcagg

SEQ ID NO: 162 - DNA, 392 bp, Homo sapiens
  misc_feature 72: n = A,T,C or G
tacggctgcgagaagacgacagaagggtacggctgcgagaagacgagagaagggtacggctgcgagaagacnacagaagggtacggctgcgagaagacgacagaagggtacggctgcgagaagacgacagaagggtacggctgcgagaagacgacagaagggaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtgg

SEQ ID NO: 163 - DNA, 382 bp, Homo sapiens
tacggctgcgagaagacgacagaagggggctctcgctcgggctttctggcgccatcttggttccgcgttccctgcacaaaatgcccggcgaagccacagaaaccgtccctgctacagagcaggagttgccgcagccccaggctgagacaaggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagag

SEQ ID NO: 164 - DNA, 407 bp, Homo sapiens
tacggctgcgagaagacgacagaagggcaagctccaggacatgcaagagatcatctcccactatgaggaggaactggcgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgatatccaaaagcacgcatgagaccaatgaaagtttccgcctgttgtaaaatctattttcccccaaggaaagtccttgcacagacaccagtgagtgagttcta

SEQ ID NO: 165 - DNA, 407 bp, Homo sapiens
tacgtcttcgataagacgacagaaggggagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagggctgatggatttgaggttacctccagaagggagg

SEQ ID NO: 166 - DNA, 366 bp, Homo sapiens
tacggctgcgagaagacgacagaaggggagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaaggcatgaaaaactatggaagatactatattgctgcgtcctatgtaaagtacttggagtctgcaggcgcgagagttgtaccagtaaggctggatcttacagagaaagactatgaaatacttttcaaatctattaatggaatccttttccctggaggaagtgttgg

SEQ ID NO: 167 - DNA, 392 bp, Homo sapiens
tacggctgcgagaagacgacagaagggggcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtag

SEQ ID NO: 168 - DNA, 392 bp, Homo sapiens
tacggctgcgagaagacgacagaaggggaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcgagatctttttacagcattctttctacatgatcg

SEQ ID NO: 169 - DNA, 400 bp, Homo sapiens
tacggcttcgataagacgacagaagggggctttttataatactgtgtaaatagtgaccatctcatgggcattgttttcttctctgctttgtctgaggtttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcctcctccttttctactttcagtagatatgagatagagcataattatctgttttatcttagctgtatacataatttaccatcagatagaactgtatggttctagtacagaaactctactaccctcagcctcttatgtgccaagatttctttag

SEQ ID NO: 170 - DNA, 386 bp, Homo sapiens
tacggctgcgagaagacgacagaagggtacggctgcgagaagacgacagaaggggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactg

SEQ ID NO: 171 - DNA, 372 bp, Homo sapiens
  misc_feature 372: n = A,T,C or G
tacggctgcgagaagacgacagaaggggacagtgcttgttcggggcgctccgctggcttcttggacaattgcgccatgtgtgctgctcggctagcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctgtggtgctcggcttcccgtgcaaccagtttgggcatcaggagaacgccaagaacaaagagattctgaattccctcaagtacgtgcggcccn

SEQ ID NO: 172 - DNA, 380 bp, Homo sapiens
tacggctgcgagaagacgacagaaagggacagtgcttgttcggggcgctgcgctggcttcttggacaattgcgccatgtgtgctgctcggctagcggcggcggcggcccagtcggtgtatgccttctcggcgcgcccgctggccggcggggagcctgtgagcctgggctccctgcggggcaaggtactacttatcgagaatgtggcgtgcctctgaggcaccacggtccgggactacacccagatgaacgagctgcagcggcgcctcggaccccggggcctggaggtgctcggcttcccgtgcaaccagtttgggcatcaggagaacgccaagaacaaagagattctgaattccctcaagtacgtccggccctgtggggg

SEQ ID NO: 173 - DNA, 382 bp, Homo sapiens
  misc_feature 382: n = A,T,C or G
tacggctgcgagaagacgacagaaagggctttctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagn

SEQ ID NO: 174 - DNA, 387 bp, Homo sapiens
tacggctgcgagaagacgacagaaggggttttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctggtcaggccacgg

SEQ ID NO: 175 - DNA, 395 bp, Homo sapiens
tgtctacggttgcgagaagacgacagaagggaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaacctggcctcgtaatgcagcctactatagccctcatggacatatattagcattagctggatttggaa

SEQ ID NO: 176 - DNA, 404 bp, Homo sapiens
  misc_feature 288: n = A,T,C or G
tacggctgcgagaagacgacagaaggggacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattatagcgaagttttattcactgtatggntctggcctaacagcttttgatctatttatctccaacttcttgttctacctgattacggctttgtggataattacaccttgcttctgtagcatcttttatgaggcgaccttcttact

SEQ ID NO: 177 - DNA, 389 bp, Homo sapiens
tacggttgcgagaagacgacagaagggggctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttggaactactgatcttgagctcataaaatacctaaataatgtggcggaacaactgacagattggttataccaaccgttcaagaacacaccccggagtgggaggattcccacacaattcagtcgaggtgaagcg

SEQ ID NO: 178 - DNA, 391 bp, Homo sapiens
ttacggttgcgagaagacgacagaagggatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagaatttttgttgtttatttataaggaaattgtgagtggggataattcgcttaccttcccgccctatctcattttctccctaacttaactcgttttatatatttactctactctggttttatcactcccagtttttctatacactcaccaacatgcg

SEQ ID NO: 179 - DNA, 369 bp, Homo sapiens
tacggctgcgagaagacgacagaagggggctgccgctgggaccccgtgacatcgtccatgccgagcacgatgccctctaaaaagggaggggatggaattaaaccacccccaatcattggaagatttggaacctcactgaaaattgcgattgttggattgcccaatgttgggaaatctaccttcttctatgagttaaccaggaggcaggctatagcagaaaacttcccgttctgcactattgatcctaatgagagcacatgacctgcgccagatgaaaggtctgactttctttgtgaataccacaaaccagcaagcaaaattcctgcctttctaaaatgaggtggatactgctgggcttgagaaaggagg

SEQ ID NO: 180 - DNA, 369 bp, Homo sapiens
  misc_feature 369: n = A,T,C or G
tacggctgcgagaagacgacagaaggggatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggtgttcatttcctgcccaagaagctggatgaggcagtggctgaagcccacctgggcaagctgaatgtgaagttn

SEQ ID NO: 181 - DNA, 384 bp, Homo sapiens
tacggctgcgagaagacgacagaagggggcgcttccgccatctttccagcctcagtcggacgggcgcggagacgcttctggaaggaacgccgcgatggctgcgcagggagagccccaggtccagttcaaacttgtattggttggtgatggtggtaccggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagaggtag

SEQ ID NO: 182 - DNA, 359 bp, Homo sapiens
tacggctgctagaagacgacagaagggctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggcaagaaggggttaaaagtggaatgtatgttgtaatagaagttaaagttgcaactcaagaaggaaaagaaataacctgtcgaagttatctgatgacaaattacgaaagtgctcccccatccccacagtataaaa

SEQ ID NO: 183 - DNA, 364 bp, Homo sapiens
tacggctgcgagaagacgacagaagggtacggctccgagaatacgacagaaggggctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagg

SEQ ID NO: 184 - DNA, 411 bp, Homo sapiens
  misc_feature 367: n = A,T,C or G
tacggctgcgagaagacgacagaaggggacattttctcggccctgccagcccccaggaggaaggtgggtctgaatctagcaccatgacggaactagaggcagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcanatgatgccctggagatgtcacagattcctggcagagccatggtc

SEQ ID NO: 185 - DNA, 355 bp, Homo sapiens
tacggctgcgagaagacgacagaaggggacattttctcggccctgccagcccccaggaggaaggtgggtctgaatctagcaccatgacggaactagaggcagccatgggcatgatcatagacgtcttttcccgatattcgggcagcgagggcagcacgcaaaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaa

SEQ ID NO: 186 - DNA, 413 bp, Homo sapiens
  misc_feature 90, 377: n = A,T,C or G
tacggctgcgagaagacgacagaagggggagaccagagatctagcgactgaagcagcatggccaagccgtgtggggtgcgcctgagcggngaagcccgcaaacaggtggaggtcttcaggcagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaaagtctgtccctgcttgccctggntaaggccagaagtctggactctcaaagagaaatgca

SEQ ID NO: 187 - DNA, 362 bp, Homo sapiens
  misc_feature 362: n = A,T,C or G
tacggctgcgagaagacgacagaagggggagaccagagatctagcgactgaagcagcatggccaagccgtgtggggtgcgcctgagcggggaagcccgcaaacaggtggaggtcttcaggcagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtn

SEQ ID NO: 188 - DNA, 419 bp, Homo sapiens
  misc_feature 419: n = A,T,C or G
tacggctgcgagaagacgacagaagggggagaccagagatctagcgactgaagcagcatggccaagccgtgtggggtgcgcctgagcggggaagcccgcaaacaggtggaggtcttcaggcagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggn

SEQ ID NO: 189 - DNA, 408 bp, Homo sapiens
tacggctgcgagaagacgacagaagggggagaccagagatctagcgactgaagcagcatggccaagccgtgtggggtgcgcctgagcggggaagcccgcaaacaggtggaggtcttcaggcagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctgggtaagccagaagtctggactctcaaagagaaa

SEQ ID NO: 190 - DNA, 412 bp, Homo sapiens
  misc_feature 378: n = A,T,C or G
tacggctgcgagaagacgacagaagggcaagctaccaatgactttcttcacggaactggaaaaaactactttaaagttcatatggaaccaaaaaagagcccgcattgccaagacaatcctatgccaaaagaacaaagctggaggcatcacgctacctgacttcaaactatactgcaaggctacagtaaccaaaacagcatgatactggtaccaaaacagagatatagaccaatggaacagaacagagccctcagaaataataccaccgcacatctacaaccatcttatctttgacaaagctgacacatacaagcaatggggaaaggattccctattcaataaatggtgttgggaaaactggccagccatatgcagaanactgaaactggagcccttccttacacattacacg

SEQ ID NO: 191 - DNA, 345 bp, Homo sapiens
tacggctgcgagaagacgacagaagggcaagctaccaatgactttcttcacggaactggaaaaaactactttaaagttcatatggaaccaaaaaagagcccgcattgccaagacaatcctatgccaaaagaacaaagctggaggcatcacgctacctgacttcaaactatactgcaaggctacagtaaccaaaacagcatgatactggtaccaaaacagagatatagaccaatggaacagaacagagccctcagaaataataccaccgcacatctaacaccattttatttttgacaaagctgacacataccagccatggggaaagggatccctattcaataaatg

SEQ ID NO: 192 - DNA, 359 bp, Homo sapiens
gcctacggctgcgagaagacgacggaagggaccaacaacagccaagtcaagtgtcaagaacacactcctattcacaactgcccccaaaagaataaaatacagctaagaatacagctaactagggagatgaaatatctctacaatgagaattataaaacactgctcaaagaaatcagagattatacaaacatatgaaaaaacattccatgctcatgaataggcaagaatcaaattctttaaaatggccatactgcccaaggcaatatacagattaaatgctattcctatcaagctaccaatgacattcttcatagaaccagaaaatactattttaaaattcatatggaaccaaaaaagag

SEQ ID NO: 193 - DNA, 354 bp, Homo sapiens
tacggctgcgagaagacgacagaagggcggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaaca

SEQ ID NO: 194 - DNA, 340 bp, Homo sapiens
tacggttgcgagaagacaacagaaggggctcttttccggttagcgcggcgtgagaagccatgagcagcaaagtctctcgcgacaccctgtacgaggcggtgcgggaagtcctgcacgggaaccagcgcaagcgccgcaagttcctggagactgtggagttgcagatcagcttgaagaactatgatccccagaaggacaagcgcttcttgggcaccgtcaggcttaagtccactccccgccctaagttctctgtgtgtgtcctgggggaccagcagcactgtgacgaggctaaggccgtggatatcccccacatggacatcgaggcgctgaaaaaaactca

SEQ ID NO: 195 - DNA, 343 bp, Homo sapiens
tacggctgcgagaagacgacagaaggggacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacagcgctctgttgaaggctggattctctttgtaactggagtccatgaggaagccaccgaagaagacatacacgacaaattcgcagaatat

SEQ ID NO: 196 - DNA, 345 bp, Homo sapiens
tacggctgcgagaagacgacagaagggggttttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcg

SEQ ID NO: 197 - DNA, 379 bp, Homo sapiens
tacggctgcgagaagacgacagaaggggaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagatttttcctaattataacaaatttttcctcattggcctgtttttaatcctgtgcctagaaggagtacaaaatgcacac

SEQ ID NO: 198 - DNA, 396 bp, Homo sapiens
  misc_feature 396: n = A,T,C or G
tacgctgcgagaagacgacagaagggcaacttccccatcctagcaagacaggccaaaattcaaattcaggaaagacagagaacaccataaagatattcctcgagaatagcaagaccaagacacataattgtcagattcaccaagactgaaacaaagaaaaaaatcttaagggaagctagagagaaaggttgggttacccacaaagggaaacccatcagactaacagcgatctctctgcagaaaccctacaagccagaagagagtgggggccaatagtcaacattcttaaagaaaataattttcaacccagaattgcatatccagcaaaactaagcttcataagcaaaggagaaataaaatcctttacagacaagcaaatgctgagagattttgtcn

SEQ ID NO: 199 - DNA, 386 bp, Homo sapiens
  misc_feature 386: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggggcgcaatctcggctcactgcaagctctgcctcccgggttcacgccattcttctgcctcagcctcctgagtagttgggactacaggcgcccgccaccacgcccagctaatttttttgtatttttagtagagacggggtttcactgtgttagccaggaactgaccgcaaacgaggccgccagacctacacccgctaccagaccctggagctggagaaagaatttcactacaatcgctacctgacgcggcggn

SEQ ID NO: 200 - DNA, 361 bp, Homo sapiens
gcctacggctgcgagaagacgacagaaggggcacctctcgccccgcaggaccatggccaacctggagcgcaccttcatcgccatcaagccggacggcgtgcggcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacttggtgaagacaggccgagtgatgcttggggagaccaatccagcagattcaaagccaggcacg

SEQ ID NO: 201 - DNA, 341 bp, Homo sapiens
tacggctgcgataagacgacagaagggacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaaggtattcaacaggagtcttacacatattaagacccaattacagg

SEQ ID NO: 202 - DNA, 350 bp, Homo sapiens
tacggctgcgagaagacgacagaagggggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcacagcaatgggcgcaggcgtttggcatctctgccctcatcgtgggtttcgactttgatggcactcctaggctctatcagactgacccctcgggcacataccatgcctggaaggccaatgccatatgccggggtgccaagtcagtgcgtgagttcctggagaagaactatactgacga

SEQ ID NO: 203 - DNA, 359 bp, Homo sapiens
tacggctgcgagaagacgacagaaggggactcttcgacgagacgacgcctgggctggacggggatatgactactgagcccagtcttgctgctctcgccacattgtatggcacgcgccaacatgaggtccctagaagcatacctactactcggacaagcactttgactgaacactactagtacacggatgttatgatacccagagaactttccaaacaagtacctaaaactcatctgatgtctgaagaggagtggaggagacttggtgtccaacagagtctaggctgggttcactacatgagtcatgagccagaaccacacattcttgtctttagacgagctcttccaaaagataacaag

SEQ ID NO: 204 - DNA, 353 bp, Homo sapiens
tacggctgcgagaagacgacagaagggtgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggcc

SEQ ID NO: 205 - DNA, 356 bp, Homo sapiens
tacggctgctagaagacgacagaagggtgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatg

SEQ ID NO: 206 - DNA, 367 bp, Homo sapiens
tacggctgcgagaagacgacagaagggggtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttggggcctcagaacagttggttatttatgtgaatcagtccttt

SEQ ID NO: 207 - DNA, 367 bp, Homo sapiens
  misc_feature 314: n = A,T,C or G
tacggctgcgagaagacgacagaagggatccgattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggnttctttgttttggttttgagcaaaagagatcggtagtgttgtgggtaggccat

SEQ ID NO: 208 - DNA, 369 bp, Homo sapiens
tacggctgctagaagactacagaagggtatcttctggggtttcaattgctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgggaaatcactg

SEQ ID NO: 209 - DNA, 362 bp, Homo sapiens
tacggctgctagaagacgacagaaggggggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttgg

SEQ ID NO: 210 - DNA, 364 bp, Homo sapiens
  misc_feature 364: n = A,T,C or G
tacggctgcgagaagacgacagaagggggcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgctcagaaccgctcctacagcaagctgctgtgcggcctgctggccgagcgcctgcgcatcagcccggacagggtctacan

SEQ ID NO: 211 - DNA, 350 bp, Homo sapiens
tacggctgcgagaagacgacagaaggggccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctggctaaat

SEQ ID NO: 212 - DNA, 365 bp, Homo sapiens
tacggctgcgagaagactacagaagggggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatccttg

SEQ ID NO: 213 - DNA, 357 bp, Homo sapiens
tacggctgcgagaagacgacagaaggggcttttttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactca

SEQ ID NO: 214 - DNA, 370 bp, Homo sapiens
tacggctgcgagaagacgacagaaggggtgacgctcgtcagtggcttcagttcacacgtggcgccagcggaggcaggttgctgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcagggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaa

SEQ ID NO: 215 - DNA, 367 bp, Homo sapiens
tacggctgcgagaagacgacagaaggggctttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaataggacagaccctgtgctttcatgaaagcgaaa

SEQ ID NO: 216 - DNA, 374 bp, Homo sapiens
tacggctgcgagaagacgacagaagggggcaggtggctgcatagtcttggcggaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgc

SEQ ID NO: 217 - DNA, 358 bp, Homo sapiens
tacggctgcgagaagacgacagaaggggcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtgacccgcctgcaggattttaagcttgactttggcaattcccaaggcaaaacaagtcaaacttggcatggagggatagccacc

SEQ ID NO: 218 - DNA, 352 bp, Homo sapiens
tacggctgcgagaagacgacagaaggggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtga

SEQ ID NO: 219 - DNA, 365 bp, Homo sapiens
  misc_feature 365: n = A,T,C or G
tacggctgctagaagacgacagaaggggacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaan

SEQ ID NO: 220 - DNA, 367 bp, Homo sapiens
tacggctgcgagaagacgacagaaggggcttgtccagtgaaacaccctcggccgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggc

SEQ ID NO: 221 - DNA, 376 bp, Homo sapiens
cgttgctgtcggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagatgagaactccagcaggtcattccgtatcacaatcctgcctcagctttacattcagcccatgatgggggccggcctgaatta

SEQ ID NO: 222 - DNA, 381 bp, Homo sapiens
  misc_feature 381: n = A,T,C or G
cgttgctgtcggatatgatgttttattcctagcctttcttcaacacatggattcattctgcaaagcaggtgagagaggaggcaggtcaggtctttactagaaagccttacctgacaccagatgctgtagagaaacccagtttctagaaggctgtcattgtccacaggtctggggagaactctttttttcttgcacatctcaaccctcttcatttggggaattcacaattgtgtaagtcttggtggaagacaggatcctgtttctggtcaaggaaaatacaaggtcagatatgttgtctccctgaacgttggtgtgtgaatcagggttcctcagagaaaatagaaccaataggggcttgtgtgtgtgtgcacgtgtgcacgn

SEQ ID NO: 223 - DNA, 462 bp, Homo sapiens
tgatacccgctacttgttccttttgcaggacttctctcaagacccaatccattcgtattccgttgacttgggagagtttgccaggtaaaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaaggaaaaaatttctttcaattggtcttcccattgcaggtactgatatttctcttttt

SEQ ID NO: 224 - DNA, 414 bp, Homo sapiens
  misc_feature 261: n = A,T,C or G
cgttgctgtcgaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggnttgtcagttcttggtgctctgtgttcccagaggcaggcggaggttgaagaaaggaacctgggatgaggggtgctgggtataagcagagagggatgggttcctgctccaagggaccctttgcctttcttctgcccttttctaggcccagggctg

SEQ ID NO: 225 - DNA, 412 bp, Homo sapiens
  misc_feature 412: n = A,T,C or G
cgttgctgtcggttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcataccn

SEQ ID NO: 226 - DNA, 417 bp, Homo sapiens
ggcacgagggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctgggctggaggggtccgcctggcagatggtgagaaggggtgggtgccccaggg

SEQ ID NO: 227 - DNA, 404 bp, Homo sapiens
ggcacgagagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgc

SEQ ID NO: 228 - DNA, 761 bp, Homo sapiens
  misc_feature 3, 737, 743, 753, 758: n = A,T,C or G
cgnttcgaattcgcacgagcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgacctctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgcagctacaatcccatggtgctcattcaaaagaccgacaccggggtgtcgcttcagacctatgatgacttgttagccaaaagactgccactgcatatgagcagtcctggtccttcacttgtgcacctgcgcnggggangcgaacttanttgtnctt

SEQ ID NO: 229 - DNA, 765 bp, Homo sapiens
ctcgttcgattccgtgctgtcggaaaacccccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaaagtggtcgaagtaggccagaaattaattaataagcccatggtgggtcctgaggctggtggtactaaggaagttcctattaaagaaatagttgaaatgaatgaaatagaagaaggtaaaaataaggaccaagccataaacagttcagagaacataatgggcatc

SEQ ID NO: 230 - DNA, 460 bp, Homo sapiens
cgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcgttcaacgccctcctccccctcaacccaccttcccaactgggacattctcaagcttttcacaccgaaaaggaaaaaaaatgttatttttagatacattttatgaataacttttgttatgaatatggctgggtaaccattgtgtatgttattaa

SEQ ID NO: 231 - DNA, 463 bp, Homo sapiens
  misc_feature 112, 116, 139, 153, 331, 432, 463: n = A,T,C or G
gtcaaaggcagcaagcagatagactcaaggtgtgtgaaagatgttatacaccaggagctgccactgcatgtcccaaccagactgtgtctgtctgtgtctgcatgtaagagtnaggnagggaaggaaggaactacaaganagtcggagatgatncagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactganatgaatgtctttcctctccctgcctcccaccagacttcctcctggaaaacgctttggtagatttggccaggagctttcttttatgtaaattggataaatanacacaccattacactatccacagatatagcn

SEQ ID NO: 232 - DNA, 495 bp, Homo sapiens
  misc_feature 331: n = A,T,C or G
aatctctacagctgtctataacaaaactttttaggaaagtaccacaaatatgttaaacagaagaagcaaatctcaaataatgtgcaaaagctgtgagtttcttcttacataaaactggtacctaagcaagtgagggttcattttatttttcactcaccaatccccatatcattatacagtaacaccatacagccaaaacggccatgatattcctcccttctcagccaaaattgggcaagagagaatgacccttgtaggggaaaagaaacctctacgataaactgaaatgccaccatcagggtttgttgaaactgtaggaacagggtctacngactcacttagctgctaatgagtttctatgattccagattggagtagttcaaagtaagaagtgaaggggctggacctgtctgtgaatcagaatgagcccacgtcctccaggaaggttttttatagcctcctctcccaaatgggaaaagcccaaatcccatcact

SEQ ID NO: 233 - DNA, 295 bp, Homo sapiens
  misc_feature 15, 19, 45, 61, 78, 92, 170, 173, 281, 282: n = A,T,C or G
agtcgaatatgacgngganaggaagaagaccctgtgtgggactcntaattacatagctccngaggtgctgagcaaganagggcacagtttcnaggtggatgtgtggtccattgggtgtatcatgtataccttgttagtgggcaaaccaccttttgagacttcttgcctanaanagacctacctccggatcaagaagaatgaatacagtattcccaagcacatcaaccccgtggccgcctccctcatccagaagatgcttcagacagatcccactgcccgcnnaaccattaacgac

SEQ ID NO: 234 - DNA, 501 bp, Homo sapiens
  misc_feature 56, 431: n = A,T,C or G
tgactttggactctctcgggtacttgaagatgacccagaagctgcttacacaaccnggggaggaaagataccaataaggtggacatcaccagaagcaattgcctaccgcaagttcacctcagccagcgatgtatggagttacgggattgttctctgggaagtgatgtcttacggagaaaggccatactgggagatgtccaatcaggatgtaattaaggctgtggatgagggctatcgctgccacctcccatggattgcccagctgccttgtatcagttgatgttggactgctggcagaaagacaggaacaacagacccaagttcgagcagatcgtcagcattctggacaaactcatccggaatccaggcaagtctgaagatcatcaccagcgcggctgcaaggccatcaaaccttcttctggaccaaagcnatgtcgatatcgctaccttccacacaactggtgattggcttaacggcatgaggacagcacctgtaaggaa

SEQ ID NO: 235 - DNA, 410 bp, Homo sapiens
  misc_feature 302, 303, 309: n = A,T,C or G
gcagccacagctccgaagctggcaagaaggatgtcagtgggcccctgaggagctgcgccctcggtctgcacctgcgaaagggacctcagggctatgggttcaacctgcatagtgacaagtcccggcccggccagtacatccgctctgtggacccgggctcacctgccgcccgctctggcctccgcgccaggaccggctcattgaggtgaacgggcagaatgtggagggactgcgccatgctgaggtggtggccagcatcaaggcacgggaggacgaggcccggctgctggtcgtggaccccnnagacanatgaacacttcaagcggcttcgggtcacacccaccgaggagcacgtggaaggtcctctgccgtcacccgtcaccaatggaaccagccctgcccagctcaat

SEQ ID NO: 236 - DNA, 304 bp, Homo sapiens
  misc_feature 2, 7, 19, 45, 62, 72, 82, 83, 87, 88, 89, 99, 100, 102, 119,120, 135, 150, 161, 162, 168, 172, 173, 174, 190, 192, 219,221, 228, 249, 250, 256, 273, 300: n = A,T,C or G
tnacganatgacagatttnacaaataacaaagtctacgccgcaanaattattcctcacagcngagtagctanacctcatcanngggnnnagattgacanngnaatagagcttcacaganntcttcatcataagcntgtagtgcagttttnccactacttcnnggacanagannncatttacattctcttngnatactgcagtagaaggtcaatggctcntnttttganagcaagaaaggtgttgacagnnccagangtccgatactacctcangcagattgtgtctggactgatataccntcat

SEQ ID NO: 237 - DNA, 570 bp, Homo sapiens
  misc_feature 503, 515, 533, 548, 556: n = A,T,C or G
gcttgatctggccccgctcgtccagcaggatgttggagggcttgacgtcgcggtggatgacaccgtgcttctccttcaggtagtacagcgccttcacaatcgccactgtcatcttgcccagaatgcgctcggggatggggccctgcatccgcttcttgagcttctcagcgcaggtgcccatgagctccatggcgatgaagacgtccgtgttggtgatgaacgtcccaaagcactgcacgatgtaggggcagtcgtggctcttcagcaccacatccaggtccatgaggatgcgcttgttctcctccttgttcccggagcgccgcatttgcttaacggcaatgacgtggccggtcttccggaagcgcatcttccacacctggccgcagtgccgctgcccatctcgcccaagttctccaggtcgttgatttctgcctggtagcgctggcccccgatggtcaggtaagccgtctgctttcatgatctcctgcagcttctggtcaatntcaatgctctcnatgctgcggggtgtgaanagggtttaacgggangccccagnatgtgggcggggcc

SEQ ID NO: 238 - DNA, 648 bp, Homo sapiens
  misc_feature 1, 454, 581, 611, 634, 645: n = A,T,C or G
nattcaggcactagggaccagcctgggcaactatagtgagataggtctccacaaaaaaaaaaaaaaaaaatagccagtctgggtgccacacacctgtagtcccagctactcaggagactaaggtgggaggattgcttgagcccaggagcggaggtcgtggtgagccactgcactccggccttagagatgcagcaagatcccatcaaataattgatagattgatacctagctagctagctagatagatgatagcaaattttgagggaagatcagaatattttacaattgaccataaagaagtttaggtacattacaatgcaaaaacacaaaaaaacccaggctgtcgaagttgaatagtttttttcttcaaggtcattgctctacattcatattatgatgtctggaaagacatgttaattttcagaacatagaattactggtgaggaagttgaanaacattccttttttccctcctatagcacatatggtatcatttctaaacatatttggatgtgtgcacttcatggcctggactagggtgaggcaagagaaattttataagacccaaatttaaggaggcncattgtcctaaggttggaacagtgtgagcncctgcatctgcaccaccctaaangtggaatggcncct

SEQ ID NO: 239 - DNA, 398 bp, Homo sapiens
agctcctgctccttaaagctgagatcacgctctagtttctttagcctctcaagagttgcctcaatttcgcacctccactccgccttgttgtgtacgaatgagttacacttgtcacgaaggctcgtgtcatttgacatggactccaggattgaaatgatttgcttgaatgatggccgtttcttggcatcagcttcccaacactgatgtaacagttcagcaaaacttctggggcaactgcttggaatggttaatctctcgtttttttccactacaagccaagctacttgtaatccttccaaacctttaaaggggacctcccttgttagcatctcccagagaaccacaccataggaatatgtgtcacaagtttctgacacagggagactctggataacttc

SEQ ID NO: 240 - DNA, 294 bp, Homo sapiens
atcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaactgcacatcggaacagggaaatgggaagacatgatgacctttggtccttattctacatgttggtggagtttgtggttggtcagctgccctggagaaaaataaaggacaaggagcaagtaggc

SEQ ID NO: 241 - DNA, 501 bp, Homo sapiens
gacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagagacatacagaaaagtgatgaactggaaagaaactctggtatttcctccagaggtacct

SEQ ID NO: 242 - DNA, 350 bp, Homo sapiens
cttaccgccaagtgaactgcttttcccacctcagccagacttactgtggcagctttgcttacgcttgcccagagatcttacgaggcttgcctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcacaggagtgcaaggtccaactgctcattgcctgtgtggcacaatggagaaaaactcaggcaagacctctctctcacctgctctagaacctgatcctccagatgctacgcc

SEQ ID NO: 243 - DNA, 466 bp, Homo sapiens
caaccttaaccaaatcggcagcagcacctcgaccgcccacacattcctggccaatcagctcagctgtttatttaccaaatgtcttcacaacaactacagcagcagccttcgcgtaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgac

SEQ ID NO: 244 - DNA, 511 bp, Homo sapiens
cggtatgtgaagccagataatattctcctagagtgcaatatgcagatcggacgtgcagatttcggattctcctgccacttggaacctggcgagaagcttcgagagttgtgtgggaccccagggtatctagcgccagagatccttaaatgctccatggatgaaacccacccaggctatggcaaggaggccgagctctgggcctggggggtgatctcgtgcacactcctggctggctcgccagccttctggcaccgtcggcagatactgatgtgacgcatgatcatggagcggcagtagcagttcagttcccccgggtgcgatgaccgttgcagcactgtcaaagacctgctctccagtatcgtgcaagtgtgtgctggggcaggagtggcagctgagcaggcgctacggcagcgcttcgtgtgagcggtatcgagtgcacaagccgggaaactgatcccgcgtgaggggttcccaggttggtagtcgtgagggctggctgctgggagagtgg

SEQ ID NO: 245 - DNA, 495 bp, Homo sapiens
cctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgact

SEQ ID NO: 246 - DNA, 432 bp, Homo sapiens
tttttttttaaggttaataaacagctttatttgccttgtacagcatcaattttcttacattctcagttaattggccattaaagtgctggaaattttcttaatcatgataacatttgttaaaaagaaatcagaactaatatcaggaacatggcggcatgaaggaaacagttcccttacaaaacacagaaaatggaagcccctcatgttgagggggtgggttggacaatttgcaaacagattctaatttcctctcaccgtcagcaccaaactggctgggaccaccacccctgggtgaaagaaacaacgctaaagaaccctaaaaacacccacacaccctgactaccaccacctctgggccatctgtgggcgtttgctgtttgaacagatccagtctcaggaaagaggaagacctgacctccgtctgcaacccat

SEQ ID NO: 247 - DNA, 330 bp, Homo sapiens
gaacttcagaaactttcaaagtttgatgagcagagaactgctacttatataacagaattggcaaatgcctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgagg

SEQ ID NO: 248 - DNA, 437 bp, Homo sapiens
gttgcttttcctttactgtgaagataatataatccctgcagtgtttctctgctaacatatgcaatttgcagttctgacagaggtccagttacgtgataaatatcctgtaaagaaccacctccacaaaactccatgcaaatccaaagcttatctcgcctgagatagcttccaaaataagcaacaatatttgggtgtttacagtctttcatcataataatttcttgctgcacaactgcaaagtcttctcctggttccaattttattactttaattgctgctaattcaccagtgttaacattccgtgccttgtagacgtcgccgtagtgccgctgccgatgcgctgaatcagctcgaagtcctcctgcgggttccggcgggacaaatcgaagccggggttcatggcgggccccaggtgccccccgcctccctcccgggca

SEQ ID NO: 249 - DNA, 400 bp, Homo sapiens
attaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggcttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcg

SEQ ID NO: 250 - DNA, 507 bp, Homo sapiens
ggattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttg

SEQ ID NO: 251 - DNA, 396 bp, Homo sapiens
agaatacctgctggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgca

SEQ ID NO: 252 - DNA, 576 bp, Homo sapiens
caggacccgaacccctacagcttccagtcagacgtctatgcctacggggttgtgctctacgacttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagccgccttgtgccttaggcccgccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggaccccgccaaagactgagccccctgtct

SEQ ID NO: 253 - DNA, 387 bp, Homo sapiens
caggtggtgttattgtaatagtctgagctgtaaattcttcatcaaaatatctagtatctgtctcagatgttacttgaggtttaagaggaggtacaagctttttatcatatacatcttgccagtttactccagagaagaaactgtgtctcataatttcttttgcgtcatctggtcctccaccaaggcgtttatttggatcctttatcaagagccctgaaagcaatgattttgcatctgaagagagtgttcgaggaaatttaatgtcttccattaatattaattcaaaaagtttctcatggtcctggttgtagaaaggtaacctcccacacatcatttcatacatgacaacccctaggccccaccagtctactgctcggccatagtcat

SEQ ID NO: 254 - DNA, 739 bp, Homo sapiens
  misc_feature 477: n = A,T,C or G
ttggaaggaaaaagtgtaaaagttattgttgcatatttgggaacagcaagcacttagtttgagaaaatgaggacttaaaacagttgaatcaaaggcaataccctggtacttgtatttaaaatcaatggtgatgttctttcttaagcaacattcttctcttccctaatagctacaatatgatacagtacgcaacagctcacttgaaagtgctagaatcagaggataaagaagccataagccaccccacttacatttcgtactatacaatgcctttttggcgcttgataaatcaagcattcatgtagcattacattcaacagaaacatttctcgtactttgggtttaagatcgttgtccctccagttcggatgtcgtgacatctgactcttcatcactgtaaatattttcagccatttgccatatctgcatgatgttatcctcagacactgagcaaatgacccaaggctcattggggtnccagctaaaatctgaaatcttatcagtgtgtccgccatgaataaacaggagttctggatggccatcttctgcatcctctggtgattgttcttccccaatatacttaaatccacacattcaggcgggcggtagtaccacttgaatccgaatagtttcactatgtggagacagtggacctcgaaaattacatctcaaggagattcgaggtatggagtcttaattttaagttaacgcaattccataaagctacggtcttatccgc

SEQ ID NO: 255 - DNA, 459 bp, Homo sapiens
aaaaaaagtgtttatttcctttattttaagattcagtaggatagccaaattcatagagaataaaattacatgaaagagttacaagctcactgttttaaagacttgacatttttcatttagttttaattaacagtaaataagtcacctcctgtttttcaatgttcaccaaaaaaagaaacatagaatggggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaagaagtgagtgctcttatgtcttctgctggctctccataagtactgtaaattt

SEQ ID NO: 256 - DNA, 305 bp, Homo sapiens
gacccttaaataaagtaattagtttagggtgttgtaatcaatggataaaactcttagatggaaattgatgatgaactttattatggaatcatcagacaatctcaacctggacctgtaaataatcttagccccactaaaagtgggataaacagacatgtgtgagttgatgtaccttaccatttatgaactactgttttaaaaaatgtgaagttaatcaagcttctagaagaaatttttgttccaagggacaactcacacggtgtctgcaataagtcaaagacatgaaaaaaaaaaaaaagtcgacg

SEQ ID NO: 257 - DNA, 554 bp, Homo sapiens
tttttttttgtcaataaaactttaggaatatctgcacatgtacatttacattcaagttgataacactggtggtttcatttcaatacaaattatgctagagaactgacatttcagacatggtcatatatatgctatttgaattcctttatcttgatacagatcttgattgtgaatctcttgatgatagatgtgcagctaatttgtcccgaaactcatgaagataattgtattgcttgatggtctgtattgccccggatcctcttaggtctcgcaggctgtctatggcttgctctggtgatattgtgtcagacaggtatagtaggagacaagcagctacaagacaagatctcccaagtcctccatagcagtgtattaaggtttttcggtaatttttaaggcaggttgtaagctcttccattatttcacagcagctggctatgtcaggagtcctccatctgcgattggatgatgatgggtgataattcacattgctggtagagatccagaaggtttgggactctatattttgacagttgccctctggtgcagaatac

SEQ ID NO: 258 - DNA, 700 bp, Homo sapiens
acatggaaatattccatgggatttatttttaacaaacatttacataaacaataaatgaaaaaaaaacaggtttaaagtgagcagattcatatttacagtgtgatttttaaggactgtctatatccaaattttattttcgtgaacgcttacattctaagagcagtacaattagcctattacgtagggccctaatcttgttagtatagtgttgttgaaatactttcttcagcttttgccttaacaaatccaaagatggaagatgatgacaatctggaatattcaacataacatgaaaaaattcattccacatatccaaatgaggaagccttctaaaaagaccttcaggcttacactctcctccttcatttttcactttcatgtaagtgccaaagagcatgcaatatactgttgcagcaaccccaaagtaatcgatctggtagttccatggtttgttgctgagcatctcaacacactgaaaaccagatgtatcacactttgctgtgaatatagttccttttggaaaaagtttcatatctatactctgacccaggtcaatcagtgccaagccagcagataaatcatcctcatcaatcctgtccaaaaatacgtttccaagtatgaaattgtctggtttaatgtctccatgaatgatttcacagtcatgcacttgctcaatcatgttaagcatcctcatagcaaa

SEQ ID NO: 259 - DNA, 902 bp, Homo sapiens
  misc_feature 368: n = A,T,C or G
gagatggagtctcactctgtcaccggggctggagtgcagagggagattatctccaaaaaataataatgataaaaaaaaattaaactgctctctcattataaagtcaggttcttgtttcagtaggagttaaaaaatagcttctcctatcctgatttgaggaagtgggggaaagtcctaggcctgtatgatacagggccagaattcagcaaaattactgtgcttctttcaaagcttcctttctacctgccagcatcaatacattcctttctcaaaagatgttttattttggtttttaataattaaaagaaaaaaactatcttcccttgtaagacttttaacacattatagtatctcagaagagcaggtanaacatcaaatataaaagaaaaataaaatcttgatgaataattaatattatatatcttctacaatttgatacacaaaacaataaagacttaattttaaccttaatactacctttagggacttttttgaacagcagaaatcatatctccatttttaattgtggtacttttatggaagcttcccaaacttcttttgatatgtctactccagaggacatctacctcataagcagaccaatcggtattatttatttgctcatgatgcatcactagtttctgcagactatttgctaggaatccggatgggattaatatcaaatatttaaattcatcatatggtggtggtggattcctaaattacttacaaatattaccgggacctccagtccaggattaatggaagctcagtccccttaatgaggaaattccaaatttttggggatatttttgggaaggaaccggttttggcggggtccccaataacgggaaatgtaggtttaaagacctaagttgggagttttgctgagtcgtgggcgg

SEQ ID NO: 260 - DNA, 669 bp, Homo sapiens
  misc_feature 519: n = A,T,C or G
atcaaagatttttattgattcccctgccaaacacaactgatttccatctacaattactttttaaggtaagaaacagtaagtcaactgaacaaagagctgggctttgggcctggaaacgtgattacacaccgactgagaaatgcaggacctcagggtggggtctagtcaggctggccgcaacagggcacgaacctgcctcagtgggccttctccaagaacgctctgcagcacctgacacactgctggtacaccgtctcaaagtcagagtcattcccataatagggatcttcaataaaaagttgtttttgtggatcatagctcccaagtagttcaattttagctttgcaggttttaacttgattactttttctattcaaatctcccagattgctttcatccatacatagtatataatcaaatgtggcaaaatcttctttggaaatctgccgggaaacgtggcccatgggaatgccgtgcctcttcatgcagctctgccctcgcaagtcaggggggttactnatcccaaacccggaagttgccgcgctgtataccccccaatttctcgaaaagttttgatcggttacaagtttccgaaaaaatgcttctgaatgggggatcgacaaagttacccagaaacccaaaaagcagggactgggagccgtttccgcc

SEQ ID NO: 261 - DNA, 551 bp, Homo sapiens
cccctttcagatggaatggtttatttaaatcagatgtaaatagtagaaagagccagattacaagccccacggtccattagcctcaaagacaggaagtctgcccatcctcccaggttttcctggtcccaatctcctctgagagctgaaggtttttgctggtgtcccctcactgctccagggacaccgtcagctcatggcatcgtgttgtagaccctgtagttgtccttctgcgtgatgtgcagcttccaggggaagaggcgcttctgggaggggaggccacgagtctgccgcaccatgagcgctacgtcctcatccgacagcagccgaaccagatccccctcagcgtcccggtaattcagagctatgtcctctctctggaactccgccttgtgagctccacaggtctttcaataggggagtgctgctgagatcttcctcaccgcgatgtccttgatggtgctgatggtgtctcgtagtagtagcaaccagccagttggtggggtcgtcctctcatggaagtctttgaggatcttacgaggagagaggggaaa

SEQ ID NO: 262 - DNA, 879 bp, Homo sapiens
  misc_feature 519, 596, 765: n = A,T,C or G
ttttttttttttttttaacaatgactctttataaacttgtatggggtctaaattatcccttgtaatatatatgtgtgtattcattccacagagaattagatgatccgcctccaggtaacctgctgggaatttcttgagattttggctccccttgaatggccgcatccaacttgttttgttagaactcccagcatcacagcgatggcagctctcttagattccccatacatccacgacctatatcatgtccaataaatcgtccacatcaccaccttcttcaaatacagctgctgtgtctccacttggtttgtctttgggggccagaaactttttggcttcctcagctgtgacagaacttccagaggcttcctctttggtgatcagagtaattccatcctggacaacaatttcccagaaatgatttaattgtttaatttccactttctcttgaagggctttcaggaagttgttaaagcgctgctcttctgaaaacttaatggcttcttccccgaaggctcngatgcagtctatgctcttcataaaatacggtgtttcattagtatccaaaaactgttcgatgtgatttatgagctggntactcgcttcctcaaagctggcctttcttctgtttactagaacacggaaagtttcagcaggattcacactttccacagaggtgacactgccttcagccagactggagaacctgaagtgggcccccccttgtcagtctttaatttttagcttggagtccatcttcatggntggcttggaaaaattccctgacagccacttgatcctttttttggcttcaatcaaagaaaaaggtctttattttaaagagaggatttgacttttcgttgcacctaacgggaggat

SEQ ID NO: 263 - DNA, 479 bp, Homo sapiens
  misc_feature 402, 447: n = A,T,C or G
gggtttttcactcgtctcctcacactcctctggagtactactgctgttttctgaagacgcgagggcaagtgcagccagccgtttcttttccttctttaagcgtttcttctcctgtttctccagcttcctagtaatctcagcagccgcttcctctgcctgaaccattgcttccttcatgacatccagattctttcgtggtatctctccagtctcatagaaggacagtcgctcttcaacttgttctcgaagcttctccccgaatacactcgtgggcacctcagagaagcaatcgattcgtgaggcaatactgcatttgtttgccaggtatcgggagatgcggcctttgttcttggcagctgctcggccaatgaaggtggagtggaaaatgagtccatattttgnggtgttaccccttgtcttcagggctctggaaacttggtccctttngctgggccctggaatcactcagacaccaggac

SEQ ID NO: 264 - DNA, 736 bp, Homo sapiens
  misc_feature 608: n = A,T,C or G
ttttttttagctctcttagaaattttattggtcctggagaaaggaaggcaaactctgcctcccgctcagagtccccccaaccctcactgtttcccgttgccattgatggggaggttcacgtactcaggggaggccaggaaggccttgagcttgggccgggcactgaggcgccccacatatgctgagagcagggggaacgcatccaggcagccaggggctaggacctcatggatcagcagcaagtccagcaggttgtagtcagcgaaggagatctggtctcccacaatgaaggtcttgcctccctggttctgggacagcagggtctcaaaaggcttcagttgcccgggcagtgccttcacatagtcatccttgcccgcctcatagttggtgtagatgagggagatgtatttgcagcggaggtcctccacgccgtcattcaccatgtccaccagggctgcctcctgctggtccttcccatagagcccaagggtgcggcccaggtgacgcaggatggtattggactggtacagggtgaggtctccgtcctggaacttggggagctgcccgtataggcaggaggctttgagtgagcccttctgccacgtctncacggtcaccacctcctccttccagctctggccctgatctggcagcagcatgcgcagggccgggcagcggccctcaactgggaaataaacaacggggtagggccgcaggtgggcaaaaactgggggcg

SEQ ID NO: 265 - DNA, 691 bp, Homo sapiens
aggtcgttttttactagtgtgtggaagacatttaggagaattccaactgattaccatttacagtgatcacaatgaaactgctcagagttatcactgaacttcagtaagaaaatacaacagagtgccatcaggacaggggagagggcaggagactgctccatcgctctgctcatgtccacactgccaaggtccccaccacgggggtccccagtgcaccccagctccggggcagaagaggcagcctgcagatctctgctgccgggaaagagctcctgaagttgtggggtctggactctgctggggacggggccttccgcgagtctcccacctctcgggggactgcagggagaggcgtctccagtgggcagccttgggtcacttccatagctcccccagcggcttctctgtggcagtgcggatggcgtcctcagagagcacgcggatgtcctcatggacagcttcgatgcttttggaagcatccaccatcttccagttcaaagtcgtgtctttcatgagctggtggaaacaccggagcgcccgctcctgaaaagccccgttctcatagcgctcatggccaaacgctccccgctttgcagcatccgccagctgtaactggaggtacaggaccaagtcgggtttgggaaggcccacgtctgggtgttacaccaatctaaggaaaaatcttcctggc

SEQ ID NO: 266 - DNA, 820 bp, Homo sapiens
  misc_feature 543, 662: n = A,T,C or G
acagctgatgaggatttataagtgtgattttaaaaacagccgatttaaaccatgtacaaataagtttgcaaaaagtctgccaaacaaaacatactttaaacatgtttaagtagatagattatctgaaattctggatttttcactcacttcattgttatgctatggcagccaagtaatccttaacttcacttggagtaagcctcctaaatccagcttcattgcagattccaacttctatgttatcctctgtcatttgcccttcaaagctttcctttagggttaagatggctgtatgaatggcatcttcaagttccagatcttcattatatcttttctcaaggaaagtcttcccattcacatagttctttcccattgctgtagctttccaggcaaagtaagctccacatggatctgactgaaataaatatggtcgtccctcattccaaccacaaataagtaaagaaactccaaatggacgaacaccacctgactgagtatattcttgcatcacagaagctactctctgtaccagctgagctgtangaatggggtgcttgtacacacgatagtattggtgagctagtgttcgagctctgtgcacaagcactctgtaatcggggcacatgccactgtacaccaaacctatatgcttgggtataggntctactgtgggtacacttctgtcatcatacagaatggatttctgttttttcttcattgctaataccacacaatttggagttttattctcagggcgggggctcctcagctcagcaagccaagctattcatcttggcaatttaccaaacggctgaagtag

SEQ ID NO: 267 - DNA, 256 bp, Homo sapiens
tttttttttttcaagttgctgagcttttctgggcatgagttttcttgtattgaaagtgcagataataattacttacctcacagggtcatttggatgaaatgaaatgaagtggtgagagagtgtctggcacagagaaaatgctcaataggcgctgattacctcctatgtctcctgttcccttggtgaccttcctcatgtcaacattagctttggccccacaaattagtgccccttctgtcgtcttctcgcagccgta

SEQ ID NO: 268 - DNA, 730 bp, Homo sapiens
  misc_feature 570: n = A,T,C or G
tgtcaataaaactttaggaatatctgcacatgtacatttacattcaagttgataacactggtggtttcatttcaatacaaattatgctagagaactgacatttcagacatggtcatatatatgctatttgaattcctttatcttgatacagatcttgattgtgaatctcttgatgatagatgtgcagctaatttgtcccgaaactcatgaagataattgtattgcttgatggtctgtattgccccggatcctcttaggtctcgcaggctgtctatggcttgctctggtgatattgtgtcagacaggtatagtaggagacaagcagctacaagacaagatctcccaagtcctccatagcagtgtattaaggtttttcggtaatttttaaggcaggttgtaagctcttccattatttcacagcagctggctatgtcaggagtccctccatctgcgattggatgatgatgggtgataattccacattgctggtagagatccagaaggtttgggactctatattttgacagttcccctctggtgcagaaaacaaatatgtcttgtataccacangctctttagtttcttctgtatctttttggacatttcttctaaccatcttttaatttacaaccctgaaggagcacataaaacccgagaaactgagaaccaattcactcgtgacaaagaatagccatgatatatgaaaatggagctgttcaatctcaatagg

SEQ ID NO: 269 - DNA, 519 bp, Homo sapiens
tttttttttttcggggtctcgttgctgggcgagggcgtggccccgtcctcggccttgggcgaagaagtcgaggaggcggccgacgcggcctctccctccgcggccgtgggcgagccgggctcggcagcctcgccttccgcgggggcctccttctctaccgggctggccccggcctcgggggcagcggcggcggccggctcacctttctcggccgcggagggcgacgccgccccgctcccggcggccgcgggctcctccttgtcggcggccggggcgctgccgttggcctgcagctcctccttggcgcccgactcggcggccgcgggcgaagcgtcgccgtttaccttcacgtggccattctcctgtccgttcgctttggaaggcgacgaggccacagccgcctccccaggcctctccgcggcggcttctcccttcgctgcggtcttggagaactgggcacccatgctggcttcttcaacaaagaaactcaacagatccaagaggggaaacaaagagcct

SEQ ID NO: 270 - DNA, 740 bp, Homo sapiens
  misc_feature 595, 649, 672, 720: n = A,T,C or G
gggggtttaacagtttattaggatttataagtgtcattttaaaaacagtcgatttaaaccatgtagaaataagtatgcaaaaagtctgcaaaacaaaacatactttaaacatgtttaagtagatagattatctgaaattctggatttttcagtcacttcattgttatgctatggcagccaagtaatccttaacttcagttggagtaagcctcctaaatccagcttcattgcagattccaacttctatgttatcctctgtcatttgcccttcaaagctttcctttagggttaagatggctgtatgaatggcatcttcaagttccagatcttcattatatcttttctcaaggaaagtcttcccattcacatagttctttcccattgctgtagctttccaggcaaagtaagctccagatggatctgactgaaataaatatggtcgtccctcattccaaccacaaataagtaaagaaactccaaatggacgaacaccacctgactgagtatattcttgcatcacagaagctactctctgtaccagctgagctgtaggaatgggttcttgggacacaagatagttttgttgagctagttntcgagctctgtgcacaagcactctgttatcggggcccatgccactgtacaccanacctatattgctgggtaattggntctaccttgtgtacacttcggtcatcatacagaaatggattctggttnttctcagttgctaatcccac

SEQ ID NO: 271 - DNA, 611 bp, Homo sapiens
ttttttttccggcttccaaaagctttattggcaaatatgctctataaaagaatgatcaatcctgttgcctctaagtcaatggaatgaagagctgtgtccagggacacaccacgccgtgctgaaggagactgctgttgtgtccacctcttattcatagacccagtcatgagcacaagacttgtagtcaaccagttcttcaggcttaaaccataggctgatttctttttcagcactttttactgaatcactgccatgaatgatgttcctgccaacctgaatgcagaagtccccacgaatggtgcctggctttgaatctgctggattggtctccccaagcatcactcggcctgtcttcaccacgttcagcccctcccagaccatggccacaaccgggcctgagttcatgtacttcaccagcccagggaagaatggtcggtctttcaggtcaatgtagtgctgcttcaggtgttcttcagaggcccggaggaacttcatggccacgaggcggaatcccttctgctcgaagcgcttgatgatctcgcccaccaggccgcgctgcacgccgtccggcttgatggcgatgaaggtgcgctccaggttggccatggtcc

SEQ ID NO: 272 - DNA, 498 bp, Homo sapiens
  misc_feature 440: n = A,T,C or G
ttttttttttttttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggtgtgcacctgctccggggggtggaggtgctccccacagtccgggccaggacagcctcaggggagagtgaaggccctaggctgtcgtcatcccacgtgctggagaggctgctgtccaggagcaaactgcagggtggtgagccaggcggtngtggctgctggcccaggggctgtagccagctggcagggtgagccagcccatgccagag

SEQ ID NO: 273 - DNA, 138 bp, Homo sapiens
gagaagacgacagaaggggaggagacactgtgcagatggatgcagaaactggaattttgcctccacaagttaagtaatactaatagctctcggaagctgaaaaaggcaaaaaaaaaaaaaaaaaaaaagtcgtatcga

SEQ ID NO: 274 - DNA, 339 bp, Homo sapiens
ttttttttttttttttttaattgcctcctgatgtttatcaacctacttgcaatatggaagattgaaatataaggcaataggtttcatggcacactccagagatgtttgtgctgtcctccagccttctcataattagtcacttgcgagcagtaactcagaactttttccaatttcacaggtactcatgcctcacaactgcctccccactcccagtaactgagaaatagagtgttcaaaacagtgacaatagaaaggcaaaagacctttaaagaaattccacaaagccccttggcactgatcatatagaagttttgccagaaaaatcaaacatccaacact

SEQ ID NO: 275 - DNA, 118 bp, Homo sapiens
tttttttttggctccttctagtttaatggggttctcagaatgttcaaagtatccacctaacaccccgggcagaaatcctccctttgcagccaggattatgactttacagagggaaaaa

SEQ ID NO: 276 - DNA, 414 bp, Homo sapiens
gtgctgtcgattacgagcgacactgcgattccatgaactcggtctttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaactttattgcctactacaatcacttcatggacaataccacgctgctgattgagctggaatattgtaatggaggcggaggtggaaagggcccgg

SEQ ID NO: 277 - DNA, 143 bp, Homo sapiens
gagaagacgacagaagggttaagttgttgcaacagagactatatggctagtgaagtccaacatatttactactggccatttacagaaaaagtctggactgcaaggaagaccaaaaaaaaaaaaaaaaaaaaaagtcgtatcga

SEQ ID NO: 278 - DNA, 243 bp, Homo sapiens
gagaagacgacagaagggtgtaagcacagagaggggaaaataattgttcactgttctggggtggaaagggactgaagatacaatcaagaaaaatgtgcacaaaactcatcaggaaacattggctaactgtattttctgataccgtggagttgtatttcccatgggaagtatttgaggatctactgagtcactgaagctggaactggccgcacaaaaaaaaaaaaaaaaaaaaagtcgtatcga

SEQ ID NO: 279 - DNA, 722 bp, Homo sapiens
ttttttatttcataattctcctttattaggcacaggtaaacatacatactcatggtatccaaaacctagagtatggacctgggattgtggaccccaagtgtccccagaagagtcccacctgggactttccaggtggccacaggacagaccctgcctaatcctgtccctcaaccttggtgctcaggtcagaagccccatggttgacaggcctggaccctcattccagaacagtcttgagttagacaagaactagcctcatagtttggattcttatctctggcccaaatcccaggcttaggcctggaaggagaatctcttaatcaagaggacagagatgctgggaacacagttcccagagatgggatcgggttggagctaagggcatcgggtcctgtcgcagccaggggtgcaggaggatgcctgtggctgtgagccgttcagctggctcccgacgaaggaggcagcgaaccagacagcgggcaggggccgagaggcctgcaggcaaggcgtaggccccgcggcggatcttgccgaagagcaagacaggctccgagtcctggaaggggtagtggccggccagcatggtgaagagcgccacgcccaggctccagacatcgggtggcttgcccgagtatgaagcccgtgagctgagtattctcaggttcacgttaggctgggcacgcgtgctttgtccaaaagggatcattttggcccatcagcaa

SEQ ID NO: 280 - DNA, 358 bp, Homo sapiens
  misc_feature 320, 323: n = A,T,C or G
tatacggctgcgagaagacgacagaagggcaacagtacaggaagttgggtagatgtggggacaacagagagactgtggcagaggcaggactgcagatctatggaaattgcctggaagagtcagctgtaagggatgagaatcctgagggtaaaagagaaaagggaaagactcctctttgatcttatgaagctgaaataacaagatcttaaacatgagtgagaatctgttgccccaacctaaggtgactttaaatccaaggtaaaaaacacggcatgggtattagtttgaatagggaaaatgagaactctctttgagctcanaanaaaaaaaaaaaaaaaaaaaaaagtcgtatcgatgt

SEQ ID NO: 281 - DNA, 885 bp, Homo sapiens
tttttttttttcacggtttcaatggacacttttattgtttacttaatggatcatcaattttgtctcactacctacaaatggaatttcatcttgtttccatgctgagtagtgaaacagtgacaaagctaatcataataacctacatcaaaagagaactaagctaacactgctcactttctttttaacaggcaaaatataaatatatgcactctaaaatgcacaatggtttagtcactaaaaaattcaaatgggatcttgaagaatgtatgcaaatccagggtgcagtgaaaatgagctgagatgctgtgcaactgtttaagggttcctggcactgcatctcttggccactagctgaatcttgacatggaaggttttagctaatgcccaggggaaatgcaaaaaatgctaatttgacttagggcctgtgcacaggaactaaaaggcaggaaagtactaaatattgctgagagcatccaccccaggaaggactttaccttccaggagctccaaactggcaccacccccagtgctcacatggctgactttatcctccgtgttccatttggcacagcaagtggcagtgtctccaccacctatgatggtgatgcagccccctaaaagtggctttcaccacctcatccatgagagctttggttccccgggcaaaagcttcccattcaaatacccccacaggaccattccacacaatctgcttaacccgagtgacagcctcagcatacttcttgctggtttcaggaccacagtccaagccccatcccaccagcaggtatgcaagaaggcccagtgggcttgccagtcttggcatttctcatcaacttgtcagcagtgacaaagtcaaccgggaaggaatcttcacaccatctt

SEQ ID NO: 282 - DNA, 703 bp, Homo sapiens
  misc_feature 387, 476, 535, 625, 659: n = A,T,C or G
atctctgcagtttataatactctacgtatatgaatttaaagcagttaaacaacatttgagattaaattggtaaaaaaaaaattgtaattgaattcagacttcagaaaattgtgaagtaaaaggccatgatggagaaatattaagaatctgtagaattactaaactgtcacagtattattttcctttacaaaagcatctcagtaaaacaaaaactacagaaaacgcaaagtaaaatcagagattttggtttagtactttccctgagtctcttgttttaaaaatcaaagtaaggccagttcaaaattgacccacaggtcttgcctcctccatgctgccatggggagtacatttaagacaagaggctacgcatgttgaggtggtcccagngctttattcaaatgccaatttgcccgtgtcactgccacagggttatctgacccactgctgcatgtgggcttaaagagctgtcaaaattntatcttggcctgctataatataatatgcgagactatataccacaagaagacaaacagtntcacgtattaataaatattacatttctaaatggatctcgacactatatacatcacaatattgtaacataacagaagctacacttttatgnttaaaattcttacataaacacaggttcgcgtcangtcatcttaaactctaatctacatgttacagataaactcaaaaa

SEQ ID NO: 283 - DNA, 510 bp, Homo sapiens
  misc_feature 494: n = A,T,C or G
ttttttgggacttagcttttccttcagaagtttattcttgtaaataaacatcagttttagtttccatttgaaatatttcaagaaaaaagacatatgatgaattagcacatgtataaaggagtcatcgttctccttgtagcccatccccaggatgacctcaggggctctgtaataacgtgtcaccacatatggagtcatcatgaagcttgtgcctgctgtcctggccagtccaaagtccaggattttcaatgtgcaatcagacttgactacaatgttacttggttttaaatccctgtgaataattccagcagaatggaggtgcttaatgccacacaacatttggtacagcaggtaagacattcgctcatggtctaattccatctgaatcacttgacataagttggcatccatcagttccattactaagtaaacatcttggaactcctccagcgtttttctgggtgtgaagacatttaataaactaataatgtttntatggttcacacactt

SEQ ID NO: 284 - DNA, 502 bp, Homo sapiens
ttttttttttcatatctcttgtatgccaaatatttaatataaatctttgaaacaagttcagatgaaataaaaatcaaagtttgcaaaaacgtgaagattaacttaattgtcaaatattcctcattgccccaaatcagtattttttttatttctatgcaaaagtatgccttcaaactgcttaaatgatatatgatatgatacacaaaccagttttcaaatagtaaagccagtcatcttgcaattgtaagaaataggtaaaagattataagacaccttacacacacacacacacacacacacacgtgtgcacgccaatgacaaaaaacaatttggcctctcctaaaataagaacatgaagacccttaattgctgccaggagggaacactgtgtcacccctccctacaatccaggtagtttcctttaatccaatagcaaatctgggcatatttgagaggagtgattctgacagccacgttgaaatcctgtggggaaccattcatg

SEQ ID NO: 285 - DNA, 638 bp, Homo sapiens
  misc_feature 545: n = A,T,C or G
gcaggttagcattttattagataaaaacaggaaggagggtgcctacccacccctgcctgctactggctctgaagggcactcctcaacttccccaagaaagaggacgcgtctctgacactgtgatcatgacaggggttcaaacagaaagtgcctgggccctccttctaagtcttgttaccaaaaaaaggaaaaagaaaagatcttctcagttacaaattctgggaagggagactatacctggctcttgccctaagtgagaggtcttccctcccgcaccaaaaaatagaaaggctttctatttcactggcccaggtagggggaaggagagtaactttgagtctgtgggcctcatttcccaggtgccttcaatgctcatcaaaaccaggcatggggaaggccctggcaaactgctccacccgttgcctgaggttggccagacgctgacttgtttctgagtccttaagcaggaaggatttgaaatcctggagcttggcagtcttgctcttcacctctaagccaatgttgaccccttcatctataaagtncacaactcttcgggaggcattctcaccggactgtcgagaaagtaaaggttgggccccaaagccaaagcccgccgggtgagatgcatttgggtc

SEQ ID NO: 286 - DNA, 660 bp, Homo sapiens
  misc_feature 595, 605, 621: n = A,T,C or G
gcggccgcgcggcttccaggtggcgctgcatgcatggcggggtcaggagcctggtctccacacccgccagctggtctgcggcggggccgccggacggcgctgggcgccctgcggagcacgaggccacgggcggggccagtagtctccacataaagtgcatggaggccgcctccctcctcccacgcccgcccgggaaggctccgcccggggctgcgaagtcaacaagccgcgtgcactgccgggcggccgaggggggagggctgcgcccggtccctgctgtccccctgcccggccctgcagggcgctccggaggtcctggggcgtggtcggcacagaagcatggcggccacctctccgggagggcgggcggaaccggcaggaagactgagggcctggcgcgggcacctggcggggctcctggacacgggctgcaggcggccagcctcactgctgcttgcaggccgacagccggcggatcttgctgctggcggagcaggccttgcgggcagggttgggggcccggcccttcgccctggatttggtgctcagctgcgccgcctctgtgccgttcatacacactgcctttgggaggccncggcgctgtncattgtgactggcctnctctttctggacctgtccgggcaccgtgaagtcctgagt

SEQ ID NO: 287 - DNA, 545 bp, Homo sapiens
  misc_feature 4, 372, 398, 446, 454, 482, 503: n = A,T,C or G
cttngttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctgggagcctctttgatgtacttgtgggaaaagtatgggctggccccatggaagatgntgcacagttttacagattttcctggntcccgatgtttaggaaatggtttccaggaaaaacggaggcctcagttnggcgaatncttttcggcattcctttggtttgaattntttaggcaaatttttaccccntatttgcatttttgagctaggcaaatttttcccagttacatt

SEQ ID NO: 288 - DNA, 395 bp, Homo sapiens
tttttttttttactgatatctctttaatactttcatcattcaagtttgttcagaacattacaagaggcatgaaagaaaaaataattccatttttaaaactctgtccaaagtataacatatgaaaccatgccattatctcttaggaaacaaaagcattcaaaattaatttggtattaaagttcaagattcaggactaacctcaaagtacgggcatgtgcagtgtttaagtgcaaggaagtattttcattccaattattttacagagatgctgggagtgacgtgtgcaatttggaaatattcaaatcctttaaggtttctggaactaaggtgtttaaatggaaaactggaaatgctggcatggttttcagtggggctttccatttccccgtttggat

SEQ ID NO: 289 - DNA, 284 bp, Homo sapiens
  misc_feature 18, 43, 248, 270, 271: n = A,T,C or G
taaaggagacaattggtntgggctcctactctgagtgcaagcnctgtgtccacaaggccaccaacatggagtatgctgtcaaggtcattgataagagcaagcaggatccttcagaagagattgagattcttctgcggtacggccagcaccccaacatcatcactctgaaagatgtgtatgatgatggcaaacacgtgtacctggtgacagagctgatgcggggtggggagctgctggacaagatcctncggcagaagttcttctcagagnnggaggccagcttt

SEQ ID NO: 290 - DNA, 415 bp, Homo sapiens
  misc_feature 297, 352, 406: n = A,T,C or G
aagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagnaacttacttcttgggatcagctgggagagctttaaaattgccagattttggggtnggtcagtacatgcttccatctttcccgggggggaccactctctgtggggcaccnggggactac

SEQ ID NO: 291 - DNA, 405 bp, Homo sapiens
  misc_feature 225, 228, 385, 401: n = A,T,C or G
tctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtggncancaaaattcccttgcctcttgtaacgtggcacctttatgattgagaacccatttcttattctcctaatgggccatactgtgataccatggatggctctttaattgggaacattggacttttttttttttttggcaattttaaacaattgggggtaaantccatataacatcaanttac

SEQ ID NO: 292 - DNA, 336 bp, Homo sapiens
  misc_feature 173, 322: n = A,T,C or G
gattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccccctnttggagagtgcatcacacaacgagacctatcgccgcatcgtcaaggtggacctaaagttccccgcttctgtgcccacgggagcccaggacctcatctccaaactggctcaggcataacccctcggaacggctgcccctggcccaggttntcagcccacccttg

SEQ ID NO: 293 - DNA, 236 bp, Homo sapiens
  misc_feature 22, 28, 48, 59, 75, 86, 126, 202, 220, 225, 227, 228, 230: n = A,T,C or G
cctgaagaagtattttgacatntgcaanggtgacctcgatcctgagantgtaaagtcantcctcttccagctacnaaaagggctgngattctgtcatagccgcaatgtgctacacagggacctgangccccagaacctgctaataaacaggaatggggagctgaaattggctgattttggcctggctcgagcctttgggatncccgtccgctgttactcngctgngnngntcacac

SEQ ID NO: 294 - DNA, 474 bp, Homo sapiens
  misc_feature 435: n = A,T,C or G
aaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtggaacatccgtttttggttggattgcattattccttccaaacnactggaaagctttattttgttctggattttggttatgga

SEQ ID NO: 295 - DNA, 458 bp, Homo sapiens
  misc_feature 1, 317, 423, 435: n = A,T,C or G
ngcgagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtnttttattgctcggcccagacaccatggtgcaataagattgggtgttcggtttccatcatggtctgattataaacttttaaaccttaagggggcaaggaggttttanttacaatgggancccttatttaaaacaaaaggggg

SEQ ID NO: 296 - DNA, 462 bp, Homo sapiens
  misc_feature 375: n = A,T,C or G
accagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggtaactttttttcgaacactttttccctnaacaactctaaaaggtaatgttttcactcctcttttcctactgccatgctacctcgtgtatttataaatgtgttggcaaatattttt

SEQ ID NO: 297 - DNA, 430 bp, Homo sapiens
  misc_feature 317, 337, 342, 359, 406, 412, 420: n = A,T,C or G
aggaagagatcatgatcataagacattccatgagtgagaaaacagggtgatacaatagaataggtcaattctccatacggaccagcatcaaaatccagagcatttatagagcatatggtagaggaaataggcagattttctggaacaatacagctgaagcttgagaacataaactgaggtgcatggtcgttatcatccaggacactgacaaacacaactgcaaaagaaaaatgtttcttttctgcatctgaagcttggacagttaaggtgaattttgtcattttttcataatccagaggtttaatccaaattaaagnaactccagtgttttcttctnaaggnaaaaatgttcccttctncattttccagagatgatgttgtaggatgatttctgcatgtgaccccntgttcncgggtcantttggctgag

SEQ ID NO: 298 - DNA, 399 bp, Homo sapiens
  misc_feature 346, 382, 387, 392: n = A,T,C or G
acctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagctatcggaagttcacttctgctagtgatgtctggagctacggaattgtcatgtgggaggtcatgagctatgggagagcgaccctactgggaacatggagcaaccaggatgttcatcaattgccgtgggagcagggtttaccgggttgccaccacccntgggattgtttcccacaggcatttgcaaccagtttnatgtnggaantgttggg

SEQ ID NO: 299 - DNA, 402 bp, Homo sapiens
  misc_feature 362, 376, 381, 401: n = A,T,C or G
aaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagaggcaaaaatattctggttaagaaggaatgggacagtgttgcatagcagatttggggctgggcagtcatgcatttcccagaggcaccaatcagcttgatgtggggggaacattcccctgttggggcnaccaggcgctaacntgggncccccaagttcttgggttgna

SEQ ID NO: 300 - DNA, 492 bp, Homo sapiens
  misc_feature 438, 454, 467, 473, 478: n = A,T,C or G
ttttttttttcaaaagtcttggaggatgaagaattatgactttcaccaccactatagtgttcatataaagttttagcagctttcaaaatggagttaggagaattcagaccaacaagttggcccagaacatatttcatttcttcagtggttcccttggccatttggttaactggatgagtttgaatttgaacatagggatgagccagggagctcagggaatgggatatcctctgttttgggtccctttttaaacaacactttaacacatcttgaagatctttctctgggaatatcggggaaatttcaatttcatggattagggatcaattatgggcatggtaatttagggaaatctggattaattatctggctggaatggggggttttccccgtaaggtcatataggtacaaaatacatcccaggggcccaaacatcantttgggggggcttatncttggactagggnttcccnttctntcggggggggaggg

SEQ ID NO: 301 - DNA, 504 bp, Homo sapiens
  misc_feature 363, 437, 469, 492, 498, 503: n = A,T,C or G
agatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagttcatgntggacttgctgggtgcgggaccggaacctcaggcccaaatttttcccagatttttaattacctgggacaagttnatccgcaatgttgccagcttcaaggtcatttnccagcgttcagttttggattttnaacagnccttnt

SEQ ID NO: 302 - DNA, 260 bp, Homo sapiens
  misc_feature 89, 91, 108, 183, 188, 246: n = A,T,C or G
gtctccccatcaaatggatgtccccagagtccattaacttccgacgcttcacgacagccagtgacgtctggatgttcgccgtgtgcatntnggagatcctgagctttnggaagcagcccttcttctggctggagaacaaggatttcatcggggtgctggagaaaggagaccggctgcccaagnctganctctgtccaccggtcctttataccctcatgacccgctgctgggactacgaccccagtnaccggccccgcttt

SEQ ID NO: 303 - DNA, 176 bp, Homo sapiens
  misc_feature 125, 128, 132, 134, 137, 140: n = A,T,C or G
attcggaacaggagcgctgcggccccgagcgctcccgctaccacctgcagcagaacgtgcagttctccgaggacacagtgaggctgtacatctgcgagatggcactggctctggactacctgcgnggncagnanatnatncacagagatgtcaagcctgacaacattctcctggat

SEQ ID NO: 304 - DNA, 277 bp, Homo sapiens
  misc_feature 66, 88, 99, 102, 103, 139, 144, 181, 196, 208, 255, 277: n = A,T,C or G
catcaagagcgactcgatcctgctgacccatgatggcagggtgaagctgtcagactttgggttctncgcccaggtgagcaaggaagtnccccgaagaangtnncttgtcggcacgccctactggatggccccagagctnatctnccgccttccctacgggccagaggtagacatctggtcnctggggataatggtnattgagatggtngacggagagcccccctacttcaacgagccacccctcaaagccatgangatgatttcgggacaacctacn

SEQ ID NO: 305 - DNA, 280 bp, Homo sapiens
  misc_feature 137, 159, 194, 231, 253: n = A,T,C or G
ggataatgacataacaccttatcttgtcagtagattttatcgtgctcctgaaatcattataggtaaaagctatgactatggtatagatatgtggtctgtaggttgcaccttatacgaactctatactggaaaaattntattccctggcaaaaccaatanccatatgctgaagcttgcaatggatctcaaagganagatgccaaataagatgattcgaaaaggtgtgttcanagatcagcattttgatcaaaanctcaacttcatgtacatagaagttgat

SEQ ID NO: 306 - DNA, 215 bp, Homo sapiens
gagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagggactgaaaacacaccgtcgatgaaaaccagccactgatgaacagcctcagacct

SEQ ID NO: 307 - DNA, 592 bp, Homo sapiens
  misc_feature 586: n = A,T,C or G
ctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaaagcggctgctgagattactaggaagctggagaaacaggagaagaaacgcttaaagaaggaaaagaaacggctggctgcacttgccctcgcgtcttcagaaacagcagtagtactccagaggagttgttgaggaagacgagtgaaaaaacccaaaaagaagaaaaagcaaaagcccccaagaagttcctcaggagaattggaattgggaagacccatctatctctttttccnaaacca

SEQ ID NO: 308 - DNA, 465 bp, Homo sapiens
  misc_feature 248: n = A,T,C or G
gcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccaggattggggagaacccctttaacctacccctccagaccctgatccggttcatggtggacattgcctgcgnatcggagtacctgagctctcggaacttcatccaccgagacctggctgctcggaattgcaatgctggcaagaggacatgacagtgtgtgtggctgacttcggactctcccggaagatctacagtggggactactatcgtcaaggctgtgcttccaaactgcctgtcaagtggctggcctggagagcctggccgacaacctgtatactgtgcagagtga

SEQ ID NO: 309 - DNA, 467 bp, Homo sapiens
cttaattttaatttttttaaggtgagaggtggatcatctattatgatttcacgttgttagaaagaaaaataataataaatgcaactcccagcagagcccattcttccccctctcctccagcagatgctgtttttctttccagtcactgttgttctaaagtctcatcggaacctccaccaagaagacgtggcgattcatcttcttgttttcctttctcgccttggctcagagcaggccagagcagcctgacagaggggccacaaggctcggtgaacccctgcccctcccagcaacttggtcgggaggcagaccgattcttctcctctcctcgatgtccctcacaggggaggggagggagctggggctgggggttgctaattgagttactggccctggctctaggacagggctggggatgctgtgtcagggatcacagagtgatgctaatggcaggagtaggggagaga

SEQ ID NO: 310 - DNA, 300 bp, Homo sapiens; identical to SEQ ID NO: 138

SEQ ID NO: 311 - DNA, 528 bp, Homo sapiens
ggcacgaggctattttaacactggtggggggcagcgaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagat

SEQ ID NO: 312 - DNA, 854 bp, Homo sapiens
gggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcattcgggctgagggcctggactgcagttacacagtcctgtttggcaaagctgaggcagatgagattttccaagaagtcggcgaaacgaagtagaatattttacaggagcactggccagagtccaggtattcgggaagtggcacagtgtgcccaggaagcaggcaccgtatggcggacgctgggctgacctacacattttcaggcctcacgctgtctcccaaggcctggatcccagttctagagcgcctccgggttcccgtctctggggtgactgggcgactttcatttgtgctcctcccggttttcggctgggtgtggcccctctcggggccccgt

SEQ ID NO: 313 - DNA, 499 bp, Homo sapiens
gggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatgg

SEQ ID NO: 314 - DNA, 742 bp, Homo sapiens
  misc_feature 250: n = A,T,C or G
ggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagacccnctggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccaggaatggaggccactcagcaggccctagctggcggcattcgggctgagggcctggactgcagttacacagtcctgtttggcaaagctgaggcagatgagattttccaagagtcggcgacacgaagtcgaatattctacaggggcactggcagagtccggtatcggggagtggccgtgtggccggagcgcacgttgggacgctggtggctaacctttcgggcccggggccaggccggtcccgttagggccggccgccgggggg

SEQ ID NO: 315 - DNA, 429 bp, Homo sapiens
  misc_feature 145, 311, 337: n = A,T,C or G
aggccaccagggtgactgcgggattccgatctcgcgccggagctgcgatgctagagcactcttgccacccccaccccacggacgtgttgcagtgatatcagaattttgcgtgcggtttacccgtgtttaacctctttgcgtctcncttctgaatcgtatccacttgagcatcactagactcgatctattttaacactggtggggggcagcgaggacatggttttaaactttaaaatgaaaatgtgaaactaggaatgttgctgtgagaccccttggacaaacagatttttgcactggggatagaacttgangcaatttctgtcttggcctcgcactngacgtcccttctttcctgtggggacaggatggacagattcctggtgaaaggggctcaagggggccttttgaggaagcaggaggagcaagaag

SEQ ID NO: 316 - DNA, 338 bp, Homo sapiens
gcgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggatggacagattcctggtgaaaggggctcaagggggccttttgaggaagcaggaggagcaagagccaactggagaagagccagctgtgttgggaggagacaaagaaagcacaaggaagaggccc

SEQ ID NO: 317 - DNA, 300 bp, Homo sapiens
aattccgttgctgtcggtctttcccaccacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggatggacagattcctggtgaaaggggctcaagggggccttttgaggaagcaggaggag

SEQ ID NO: 318 - DNA, 407 bp, Homo sapiens
gaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtat

SEQ ID NO: 319 - DNA, 859 bp, Homo sapiens
  misc_feature 10, 22, 49, 71, 89, 130, 715, 776, 777, 811, 824, 828, 843: n = A,T,C or G
tccggccttnacggccggggtncgctggggcgcgtctttcccaccacgnagccaccagggtgactgcgggnattccgatctgcgccggnactgcgatgctagagcactcttgccacccccaccccacggnacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagccatttctgtcttggcctcgccactgacgtcccttctttcctgtggggacaggatggacagattcctggtgaaaggggctctagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttcaagagttggagaaagaagtagatattttacaggagcactggccaagtccagtattcnggaagtggcacagtgtgccaggagcagcacgtatggcgacgctggctgactacacattttnngcctcacgctgctccaagcctggatccagtctanacctccggatacntttnggggactgacgactnacttggctatacagtt

SEQ ID NO: 320 - DNA, 836 bp, Homo sapiens
  misc_feature 10, 22: n = A,T,C or G
tccggccttnacggccggggtncgctggggcgcgtctttcccaccacgagccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcctccggg

SEQ ID NO: 321 - DNA, 1247 bp, Homo sapiens
ctctctctctctctctctctctctctctctctctctctctctccccgcccgggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagttaaaaaaaaaaaaaaaaaaaaaaaaaaaaaaaaaaaaaaaaa

SEQ ID NO: 322 - DNA, 443 bp, Homo sapiens
attgacagcagacttgcagaattacatagagaattaggaacccccaaatttcatgtcaattgatctattccccctctttgtttcttggggcatttttccttttttttttttttggtttttttttacccccccttaactttttgcccccaaaaaccaaattaaaccccccccccttttaaaagggggggggggaaaaaaacaaaaacccccaaaccccccctggaaaacccccatttcttcccccccccttttatccccccgaagggatttttttttttatttgccccttgtccttgggttaaattaaggggggacccctctggggggccctggcccattaacccccttggaaaaatcaaagggggggggaaaaagcccttttcccgcctggtttttggggaaaaggggttgcccccaaaaatccttaaggccaaagggggggt

SEQ ID NO: 323 - DNA, 433 bp, Homo sapiens
cggcacgagctttctgtttctctccgtgctgttctctcccgctgtgcgcctgcccgcctctcgctgtcctctctccccctcgccctctcttcggccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcaactcggccaaagcggcgctggcaaaggagtgtccggcaggagggccaacgcccgctgttcggtttgcaacacgcaccagggaggggggcggaagcgtccccggcttcca

SEQ ID NO: 324 - DNA, 120 bp, Homo sapiens
tcactctgaagtgttatcagcaaaaaaaattcagtagattatctttaaaagaaaactgtaaaaatagcaaccacttatggcactgtaaaaaaaaaaaaaaaaaaaaaaaaaaattggggg

SEQ ID NO: 325 - DNA, 508 bp, Homo sapiens
cggggtctcgttgctgggcgagggcgtggccccgtcctcggccttgggcgaagaagtcgaggaggcggccgacgcggcctctccctccgcggccgtgggcgagccgggctcggcagcctcgccttccgcgggggcctccttctctaccgggctggccccggcctcgggggcagcggcggcggccggctcacctttctcggccgcggagggcgacgccgccccgctcccggcggccgcgggctcctccttgtcggcggccggggcgctgccgttggcctgcagctcctccttggcgcccgactcggcggccgcgggcgaagcgtcgccgtttaccttcacgtggccattctcctgtccgttcgctttggaaggcgacgaggccacagccgcctccccaggcctctccgcggcggcttctcccttcgctgcggtcttggagaactgggcacccatgctggcttcttcaacaaagaaactcaacagatccaagaggggaaacaaagagcct

SEQ ID NO: 326 - DNA, 597 bp, Homo sapiens
  misc_feature 467: n = A,T,C or G
agagctgccaggtctgcccatcgaccaggttgcttgggccccggagccccgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtggggtgttcccggnggcacttgccgaccagccccttgcgtccccaggtttgcagctctcccctgggccactaaccatcctggcccgggctgcctgtctgacctccgtgcctagtcgtggctctccatcttgtctcctccccgtg

SEQ ID NO: 327 - DNA, 762 bp, Homo sapiens
gagactgcatagggctcggcgtgggggtcttcaggtgatggcagaggaggggaccaagagggggcccccactgaagacattggggacacggggaggagacaagatggagagccacgactaggcacggaggtcagacaggcagcccgggccaggatggttagtggcccaggggagagctgcaaacctggggacgcaaggggctggtcggcaagtgcccccgggaacacccactccggcgaggcagaatataacactgggtgggtgggtgtcctgacgaatgggcaggtaatttggggtgcctcgaagcgttttggatctcaggccaatgtgggttccacaattgtgacaatttggctctttgggcttctgtccaatgttccgaatggcccactcacagggcgcttgccgagggaccctctgcgactgaggcggactggcatggacgacccccgggtcatgccagccccgtcaccaggacccagaagcctcaggcctctagactgctagtcgggctgcatgcaggggggctgagctgggggcacaagtgggggcgaggtaaacctcccagaggccgagtccctgccgcagccctaggcgccgcggtggttggctgctatggcatcaccagacccgtgggcttccggggccaagccaacctggtcgatgggcagacctggcagctcttctgctctgtgggcttagaacccgcctgaacttcctaattgccccggctcaccccaaccttgtccccaagaggttccc

SEQ ID NO: 328 - DNA, 388 bp, Homo sapiens
ccaaaccccagcgccacccaatattcccctgaacagtactggccatgtgctccttaaagctaaaattaaaaacaaacaaaaaacagaaagaaaaaagtatccccaggtagctatgttgtaattttatttcatgacagcaccatcttctctttgcctgcgcctgggcctcctagtgtgctgcttacgtgatgcccacgtgccacagagttattgcccgaagtgccagtgggctgtgcaggggatgggctcttccttccagatggactgcaacctctgggaccacgcacccaccatcccctttctttcttcttcggatgcaatttcaggagcaaagctgatctgaggggcaaggactttaaatccacagaagtgtaatgtgccatgctaa

SEQ ID NO: 329 - DNA, 105 bp, Homo sapiens
cccgggtcgacccacgcgtccggaccaagtgctctgccagggctgtagccaggcagggccctaacccagggctcctggacccaggctttaccataccacgggccc

SEQ ID NO: 330 - DNA, 479 bp, Homo sapiens
cttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagataactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattacagccttattaaagtggcagcatcttgtggggccatccagtacatcccaactgagctggatcaagtt

SEQ ID NO: 331 - DNA, 338 bp, Homo sapiens
ttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaag

SEQ ID NO: 332 - DNA, 298 bp, Homo sapiens
ccagtagcatcgtttttccacttattctttcgagtcagtgcaatcatcgtctatcttctctgtgagttgctcagcagcagctttattacctgtatggtgacaattatcttgttgttggggggtgacttttgggcagtgaagaatgtcacaggtagactaatggttggcctacgttggtggaatcacattgatgaagatggaaagagcccttgggtgtttgaatctagaaaggagtcctctcaagagaataaaactgtgtcagaggctgaatcaagaatcttttggttgggacttattg

SEQ ID NO: 333 - DNA, 430 bp, Homo sapiens
ttcggcacgagggccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggatggtgacggcaagctgggctttgctgacttcgaggacatgattgccaaggcccctgacttcctcagcactttccacatccggatctg

SEQ ID NO: 334 - DNA, 457 bp, Homo sapiens
gaagaaaaccagcaacggccgcctgcctgtgaagtggatggcgcccgaggccttgtttgaccgggtgtacacacaccatagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgatgagtacctcgacctccgtctgaccttcagaccctattccccctctggtggggacgccagcagcacctgctcctccagcgattatgtcttcagccacgaccccctgccattgggatccagctccttcccc

SEQ ID NO: 335 - DNA, 248 bp, Homo sapiens
tgttcaaaatgcatgcgagtggggacagcttcttcctaagtgaggaaaatacaggtcatgaagttcctggcaggattttctgttaaaaacctatgctggtttgctttggatcacacccgggaaaccccgggtgctaagaatgaaaataaccttggtgagttgtacaaattaaagacaaagaactacatgtgaagatagacttgctttctatttttaaatcagtagtagtactgctgctgaataatact

SEQ ID NO: 336 - DNA, 558 bp, Homo sapiens
ccaagaattcggcacgaggggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggct

SEQ ID NO: 337 - DNA, 614 bp, Homo sapiens
  misc_feature 555, 569: n = A,T,C or G
cttttttttttttttttttgatctgctcgtagtcaacgcgcattgtggccaaggcactggtcatctcctccttgacatcctcccaccgctccttgtcctccttcaggacccggctggtgtgcagtggggtttgagggacctttgttgattgcatgatccaagggtggttcataaactcggtgatggtcattctctgggtgggctctgttttcagcagattccgaatgagcatcttcacttcctctgatacttctgaccattctgggttgggaaattcatactggcccattcggatgcgagtcttcatgcccggagagatggcaaggcgtggttggagtagaaggggggatacccacacagcaggatgtacatgatgacacccagggaccacatgtcacaggacttgtcatacttctctggacccagcacttctggagccacatagtacggtgtataacaaggagtggtcaaagagttgtggctggtggtttccttggcaaagcaaaagtcagtgagtttcaggatggcgtgggcccttttggaagtgtataaganatctcaggcttganatcccgatgggcaatgttgattgaatgcagataactggaatggcc

SEQ ID NO: 338 - DNA, 503 bp, Homo sapiens
ccggtaaccgggccctttccagctgcggctccattacaatattccagctcaatcagcagcgtggtattgtccatgaagtgattgtagtaggcaataaagttgtcgtgctgcagcagtgccagaataactatctcattcaaggcatcacgacgttccttctcagacagccgggtcaaatcgacttccttccacacaaccagtgagtcatcctcggtgcggcggtacagcgtggcttccccgaaggcgccgcggcccaggacgcggatggggatgtagtgcagttcctcctgctccgccgcgccgccgccggctcgcggcccctgactggcgctaggccccggactcgagtccccgcaacccccggactcgctcccaaagtccgagttgatggaatcgcagtgtcgctcgtactcgcccagcaccgacatggcggcggccgcaagcttattccctttagtgagggttaattttagcttggcactggccgtcgttttacaacgtcg

SEQ ID NO: 339 - DNA, 513 bp, Homo sapiens
ggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagc

SEQ ID NO: 340 - DNA, 315 bp, Homo sapiens
gaaggggaacccgaccaccgctggtcttcgctggacaccatgaatcacactgtccaaaccttcttctctcctgtcaacagtggccagccccccaactatgagatgctcaaggaggagcacgaggtggctgtgctgggggcagccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctacttcgagaagtctagggacaggaagatggttggcga

SEQ ID NO: 341 - DNA, 290 bp, Homo sapiens
gccaacacgtttgaactgaaatacgacttgtcatgtgaactgtaccgaatgtctacgtattccacttttcctgctggggttcctgtctcaaaaaggagtcttgctcgtgctggtttctattacactggtgtgaatgacaaggtcaaatgcttctgttgtggcctgatgctggataactggaaaagaggagacagtcctactgaaaagcataaaaagttgtctcctagctgcagattcgttcagagtctaaattccgttaacaacttggaagctacctctcagcctacttt

SEQ ID NO: 342 - DNA, 426 bp, Homo sapiens
  misc_feature 222, 263, 339: n = A,T,C or G
tcgactggaccagctgcgggcagagagtgcttcggggaaccaggtgtcggacatggctcaactcttctactactttgccttggaaggtacccttgctgggagaggggctggggaagggaatgggtcagggagaggttgtgctccctctcctcaagggctcctggattccatatgtcctggggtctgcctcctgtgatggcctctgtgcactactcagctatntgctacatcctgttcgagaaacgcattggctgcctgcacgnatccatccccgaggacaccgtgaccttcgtcagatccatcgggttaatgttccagaactcactctatgccaccttncttgcccaagtgggactcgccccgtggcttgcctttttgggaaggcgatgacctgggatggttgggaattgccatcttttgcctttt

SEQ ID NO: 343 - DNA, 457 bp, Homo sapiens
ttttgcccgtacccgtctagcatctgatgtgggtaaagctggagctgaaagggaattccgaggcctaggtgactgcctggttaagatctacatatctgatgggattaagggcctgtaccaaggctttaacgtgtctgtgcacggtattatcatgtaccgagccgcctacttcagtatctatgacactgcacagggaatgcttccggatcccaagaacactcacatcgtcatcagctggatgatcgcacagactgtcactgctgctgccgggttgacttcctattcatttgacactgctcgccgccgcatgatgatgcagtcacggcgcaaaggaactgacatcatgtacacaggcacgcttgactgctggcggaagattgctcgtgatgaatgaggcaaaggtcttttcaagggtgcatggtccaatgttctcagaggcatgggtggtgctttcgtg

SEQ ID NO: 344 - DNA, 463 bp, Homo sapiens
cctgcccttgtggcccatttgtgcctgggcagatgtttctggccagcagacactgaaggcctttttgctgtgacagtatttatggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttg

SEQ ID NO: 345 - DNA, 300 bp, Homo sapiens
acttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagt

SEQ ID NO: 346 - DNA, 465 bp, Homo sapiens
ggcacgagcctagtcccagagtcctggagcggcatactgggggtggctgtgcagtcccagcatccccaacccagcatgtatagagagcatccatccttacatccagctgacccatgcccatgctcctccctgtggctggaggttcaacaataacataagtctcttctttgccctccagatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagag

SEQ ID NO: 347 - DNA, 476 bp, Homo sapiens
ggcacgagaaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagt

SEQ ID NO: 348 - DNA, 612 bp, Homo sapiens
aagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccattatcaccattatgtgacattaaaggatcatatacagcgcaatttgaaca

SEQ ID NO: 349 - DNA, 398 bp, Homo sapiens
ttggagaaaccttttattggcacaggcattccttgttaacttgacagggtgaagctgtaatttttcaaaaacagtaaaagctggtttctcctaaactattttccttgtggtagtaaaaatcagtgggtcaaaaacaactcctgaccacttggtttccttttgagccgcgtcattaggaggcaatctgtaaaactagcacaggtctcccgctgttccactggctcacccacatgattagcagagtgcacgaaaaaataaaacttctattaagaacatgctgagcacaagatcagaaaagttgtgacattgcaaactccatatatgcaggggcctggaactggcgttctccaaaggctcccaacaccactctcctctgattctgtgacaatgtgaagcta

SEQ ID NO: 350 - DNA, 366 bp, Homo sapiens
  misc_feature 112, 139, 177, 193, 211, 261, 302: n = A,T,C or G
ttttttttttttttttttttttttcagatctgaaaatgtctttattttttagaaaatggattccaggaaggttaaaaagcaacaccagagggtataggtgcagaactggatntagtcattcaaagcattcaagtaagantatggcaatataaatatccaaaaagtatctcttaggtnttcaaaacaaaacgtntaagtcattcctaactantttgagctttatagcattttcctagacaggaaggggaaaaacagttagcntttaaaagtccggaaagctttttcgttggttaattacattnggacggtttgcctttgtccaaattccttcttttttaaacatgggtaaaagttttacatggggtc

SEQ ID NO: 351 - DNA, 491 bp, Homo sapiens
  misc_feature 12, 154, 255, 348, 368, 402, 409, 450, 471: n = A,T,C or G
tttttttttttntttcactgttcaaggtttattgggggttttagttggtataacacttggatagttggttgcattgtttgtatgtagatctttttacattatatggtaatgtacactactgatatagttcacaaaataagatcctttggaaganttatacacaagacatgatattggatttatacactggatcccagggatgtgactcactgggaaaaaatgttggactaggcatgttcagtgaaggagccaggnagttatataacacacggtaaacatccacctggctcaaggggcaaatgcagtacgtacagcattggcagtggtgcgtcagaggtggcagaactntttcacactaaccagttgangactacacaagattaataccatccagcatcaggntatagcntgtggattttacaaaccatttcttatttctaactttcaggngttgatgtttttcccagtccntcttaaaatttttactgctt

SEQ ID NO: 352 - DNA, 398 bp, Homo sapiens
cgttgctgtcgcgggacgccgagagcacgccatgaaggcctcgggcacgctacgagagtcaaggtagtgggtcgctgcctgcccacccccaaatgccacacgccgaccctctaccgcatgcgaatctttgcgcctaatcatgtacgcgccaagtcccgcttatggtactttgtatctcacttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccggaggcgctgtcacccagtgctaccgatacatgggtgcccggcaccgctcccgagcccactc

SEQ ID NO: 353 - DNA, 220 bp, Homo sapiens
gtggaaggatctgcagttttgtttttgacgcaaaaaaataataataagttagctctgaagggcagagggaatacccaagcccctgatgcctatgagaagtccctggacttcaaccctcctgttgtttggccttagcccagagggagctgctcacctgagcacccttgggggtgggcaaagaggcagggtgggattttagagttagtgtctgtgcgggggc

SEQ ID NO: 354 - DNA, 362 bp, Homo sapiens
gatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtca

SEQ ID NO: 355 - DNA, 771 bp, Homo sapiens
  misc_feature 3, 19, 20, 21, 22, 23, 24, 25, 26, 27, 28, 29, 30, 31, 32,33, 34, 35, 36, 37, 38, 39, 40, 41, 42, 43, 44, 45, 46,47, 48, 49, 50, 51, 52, 53, 54, 55, 56, 57, 58, 59, 60,61, 62, 63, 64, 65, 66, 67, 68, 69, 70, 71, 72, 73, 74,75: n = A,T,C or G
  misc_feature 76, 77, 78, 79, 80, 81, 82, 83, 84, 85, 86, 87, 88, 89, 90,708, 745, 751: n = A,T,C or G
acncttgacctgatcgccnnnnnnnnnnnnnnnnnnnnnnnnnnnnnnnnnnnnnnnnnnnnnnnnnnnnnnnnnnnnnnnnnnnnnnnncgaggtacagaatttattatgaaatagcttaatggcaagtggtaatttagaagaattaagttatcagataggagatatattaaaatatttaaaaattggatatattcttgaagcccttttacacaagtaatttctataatttgattgtaatgaaagtataatataccttgttactattatcagattaatttttgaaagtagaattccttaatcaagccaaggttatgctgctttataagaaattaatcaggtagtttaacactagagctcattagccaacctgtatgtagcacaaaataatcatctctgataaatacctataaatatattttattcatacttttaaatattttacaattcaaataaaaaccttatatgtagacaatctgggctaaatttccatgtatgttttgaaaaataatgttagcatgaatagattcatatttaaatatgattttaaatactcttaatagaggagacataagaaatatttacataaaagctaagtagcatgatacagctcatggttattttcctcataggaaaacaattacttgatttttttttgcataggattaaagactgagtatcttttctacattcttttaactttctaangggcacttctcaaaacacagaccaggtagtaaatctncactgntctaaggtctcaccccactt

SEQ ID NO: 356 - DNA, 374 bp, Homo sapiens
ggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcgcgtttcgatcccaaaggccctttttagggccgaccacttgctcatctg

SEQ ID NO: 357 - DNA, 467 bp, Homo sapiens
ttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagta

SEQ ID NO: 358 - DNA, 495 bp, Homo sapiens
ccgttgctgtcgcttcgtgtaagcaagtacataaggaccctcctttggtgaaatcggggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcttttctgcttctagagattgaggggaaagcttcgtccgaaaaaccccaggacaaacaatggcaaaggagagggctcctgtgacggcggcaaggcttgggaggaaacccccgcaatgggggggttttccctcggggcaggagggggggcctgaggctttcaagggttt

SEQ ID NO: 359 - DNA, 467 bp, Homo sapiens
ctgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaag

SEQ ID NO: 360 - DNA, 300 bp, Homo sapiens
gagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttacatatctctgcttcatttcttctattaatatgtttttgtttttgttttattttgtttcgtttgagatggagtctcactctgtcgcccaggctggagtgcagcggc

SEQ ID NO: 361 - DNA, 369 bp, Homo sapiens
acattgaagttgccttctcctactcctcggtcttatggccttggtcgggctacctggccatctccatttctgtgaccaagaaagcggcttcctgggaaggcattgcccagggtgaagcgcccgcagctcatgcagcaggttcacccgccaaagaccccttcggtgtgaccggcagcctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtca

SEQ ID NO: 362 - DNA, 236 bp, Homo sapiens
tcgaattccgttgctgtcgccctaaaacccgccggactttctgtaataagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaac

SEQ ID NO: 363 - DNA, 264 bp, Homo sapiens
gattaaaatttttgatgaaaatgagctggagttgctcatgtgcggcctcggtgatgtggatgtgaatgactggagacagcattctatttacaagaacggttactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaat

SEQ ID NO: 364 - DNA, 567 bp, Homo sapiens
ggcacgaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaag

SEQ ID NO: 365 - DNA, 438 bp, Homo sapiens
ggcacgaggttggcagtatgagagttgtaatggcccgactgttgagttagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttag

SEQ ID NO: 366 - DNA, 629 bp, Homo sapiens
cgccgctccggctgcaccgcgctcgctccgagtttcaggctcgtgctaagcttgcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatcta

SEQ ID NO: 367 - DNA, 477 bp, Homo sapiens
cttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcag

SEQ ID NO: 368 - DNA, 469 bp, Homo sapiens
ggcacgagggagaaccccctgcctgttcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcg

SEQ ID NO: 369 - DNA, 448 bp, Homo sapiens
ggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccacgatggaattggtagcaaggc

SEQ ID NO: 370 - DNA, 322 bp, Homo sapiens
ggcttagcggataacaatttcacacaggagctagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggaga

SEQ ID NO: 371 - DNA, 338 bp, Homo sapiens
  misc_feature 3, 39, 42, 249, 264, 269, 275, 316: n = A,T,C or G
gcnactaccaaaaagcgctgctgtacctgtgtggtgganatnactgaagcccgacacggcctgagcgtccaaaaatggtgctcaccatgcttccagccaacaggtctaaaaaaccagcttgcgaatgacagtccccgtggccatccctgtgagggtgacgttagcattacccccaacctcattttagttgcctaagcattgcctggccttcctgtctagtctctcctgtaagccaaaaaaatgaacatnccaaggagttggaantgaantctatnatgtgaaacactttgcctcctgtgtactgtgtcataaacanatgaataaactgaatttgtact

SEQ ID NO: 372 - DNA, 298 bp, Homo sapiens
  misc_feature 38: n = A,T,C or G
caagtagctttccacatttgtcacagaaatcagagganagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctc

SEQ ID NO: 373 - DNA, 404 bp, Homo sapiens
ccgttgctgtcggtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaacttt

SEQ ID NO: 374 - DNA, 300 bp, Homo sapiens
ggactgactgctgctcagccagcccctcatgtggtcaggtgacaccgcacctgtctctaggtgcctctgcttcctcctacacctgagtcataaggtcaggtgccatgctgggcgccatctgagtgtaccacatggatccacccattaatcctcctacccactatgaaataagaagcttgcttgggccgggcacagtggctcatgcctataatcccagcactttgggaggccaaggcgggcggatcataaggtcaggagttcgagaccagtctgccaatatggtgaaaccccgtctctact

SEQ ID NO: 375 - DNA, 317 bp, Homo sapiens
taagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgg

SEQ ID NO: 376 - DNA, 460 bp, Homo sapiens
  misc_feature 10, 13, 21, 23, 38, 41, 60, 67, 72, 75: n = A,T,C or G
aaactcttgnacngaactctnanacaagccctgggccnttntgcaggaacccatcgattngaattcngctcnatnacaattacggaatcatgagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaactgctca

SEQ ID NO: 377 - DNA, 107 bp, Homo sapiens
ggcacgaggttgggggcagccaggcacagccggctcacggaggggccaccacactgggccagggtctcactgtacaagtgggcaggggccgcgcttgggcgcttggg

SEQ ID NO: 378 - DNA, 499 bp, Homo sapiens
ttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcaagggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctg

SEQ ID NO: 379 - DNA, 422 bp, Homo sapiens
gctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcagttttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgctgatccacctctggaatgttgtgggaaagtcccctggaggccaaccacaccctggagggagctggtggcagcatcaccagtg

SEQ ID NO: 380 - DNA, 510 bp, Homo sapiens
ccgttgctgtcgagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgccttggggagtggtgcctcgcatgctgataacaattctgggcacggtgaagcccaatgcaaacagaattgctttagatttccaaagagggaatgatgtt

SEQ ID NO: 381 - DNA, 263 bp, Homo sapiens
atttgaaatcattgatgaccacagacctgggaaaatggttgtgaacctcacaggcaggctaaacaagtgtggggtgatcagccccagatttgacgtgcaactcagagacctggaaaaatggcagaataatctgcttccatcccgccagttcggtttcattgtactgacaacctcagctggcatcatggaccatgaagaagcaagacgaaaacacacaggagggaaaatcctgggattcttcttctagggatgtaatacatata

SEQ ID NO: 382 - DNA, 652 bp, Homo sapiens
catcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttacgacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaaaaaaaaaaa

SEQ ID NO: 383 - DNA, 490 bp, Homo sapiens
ccgttgctgtcggtgtgggaggcctctcactatctcgtacgccaggtcttcaagagtctacaggagatgttctcggggacccgggccatccagcactggctgaccgacagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgt

SEQ ID NO: 384 - DNA, 419 bp, Homo sapiens
tggaggacaaccacaaggcagacatcagctcctggttcaacgaggccattgacttcatagactccatcaagaatgctggaggaagggtgtttgtccactgccaggcaggcatttcccggtcagccaccatctgcctggcttaccttatgaggactaatcgagtcaagctggacgaggcctttgagtttgtgaagcagaggcgaagcatcatctctcccaacttcagcttcatgggccagctgctgcagtttgagtcccatgtgctggctccgcactgttcggcagaggctgggagccccgccatggctgtgctcgaccgaggcacctccaccaccaccgtgttcaacttccccgtctacatccctgtccactccacgaacagtgcgctgagctaccttcagagccccattacgacctct

SEQ ID NO: 385 - DNA, 404 bp, Homo sapiens
cgttgctgtcgggggtcgacacgctatagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagac

SEQ ID NO: 386 - DNA, 289 bp, Homo sapiens
ggcacgaggcgaccaggaccctggggaaaggaagccagcccccaaggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatcc

SEQ ID NO: 387 - DNA, 359 bp, Homo sapiens
ggcacgagaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagc

SEQ ID NO: 388 - DNA, 410 bp, Homo sapiens
caagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccgagtggtcaggagttgtttctgacccactgatctctactaccacaaggaaaatagtttagagaaaccagcttttactgtttttgaaaaattacagcttcacctgtcaatttaacaaggaatgcctgtgccaataaaagttctcccac

SEQ ID NO: 389 - DNA, 403 bp, Homo sapiens
caagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagattgcctcctaatgacgcggctcaaaaggaaaccaagtggtcaggagttgtttctgacccactgatctctactaccacaaggaaaatatttagagaaaccagcttttactgtttttgaaaaattacagcttcaccctgtcaatttaacaaggaatgcctgtgccaataaaagttctcccact

SEQ ID NO: 390 - DNA, 438 bp, Homo sapiens
aggtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccatgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcac

SEQ ID NO: 391 - DNA, 99 bp, Homo sapiens
ggtactaggctctatacactactcatctctggttttagccgattaaatacaggtttttgttgctgagatgtgagtgaaaccagctagtgtgtcaacagt

SEQ ID NO: 392 - DNA, 382 bp, Homo sapiens
ctctggcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatg

SEQ ID NO: 393 - DNA, 282 bp, Homo sapiens
ggcacgagtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaac

SEQ ID NO: 394 - DNA, 362 bp, Homo sapiens
aattccgttgctgtcgctcatctttgccagtacaggagcttgtgccgtggcccacagcccacagcccacagccatgggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacg

SEQ ID NO: 395 - DNA, 457 bp, Homo sapiens; identical to SEQ ID NO: 343

SEQ ID NO: 396 - DNA, 428 bp, Homo sapiens
aggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacaaagctgcgggaagatttggagaacacactgaaggccttgccttctgcccaggagcctgacgaa

SEQ ID NO: 397 - DNA, 523 bp, Homo sapiens
atgtcggagccaagccccactcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatgaaaaaaaaaaaaaaaaaaaaaaaaaaaaa

SEQ ID NO: 398 - DNA, 389 bp, Homo sapiens
ggagagggagtgatgtcttccagactcggtgctgtacccgccacttcgggacccacaacctttaagcagcagaggagcacgaggatcgtgggagctaagaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggag

SEQ ID NO: 399 - DNA, 386 bp, Homo sapiens
ttcgaattcggcacgaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctggcatgctcctggcgtggacacaca

SEQ ID NO: 400 - DNA, 365 bp, Homo sapiens; identical to SEQ ID NO: 141

SEQ ID NO: 401 - DNA, 494 bp, Homo sapiens
ggcacgaggccgcccggcccctccagcttcccggaccatggcctacctttagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaat

SEQ ID NO: 402 - DNA, 487 bp, Homo sapiens
caggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttct

SEQ ID NO: 403 - DNA, 267 bp, Homo sapiens
  misc_feature 233, 238, 245, 249, 251, 261, 262, 266: n = A,T,C or G
agtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgttcctggctgcagggctgctctttgncaatntaccagnctgnantgcttaccanntgtnt

SEQ ID NO: 404 - DNA, 572 bp, Homo sapiens
ggcacgagccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaa

SEQ ID NO: 405 - DNA, 477 bp, Homo sapiens
ggcacgaggtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacat

SEQ ID NO: 406 - DNA, 572 bp, Homo sapiens
ggcacgaggtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatctttta

SEQ ID NO: 407 - DNA, 452 bp, Homo sapiens
aaactgatgtttattttccatcaaccatttttccatgctgcttaagagtctatgcaagaacagcttaagaccagtcagtggttgctcctacccattcagtggcctgagcagtgggagctgcagaccagtcttccgtggcaggctgagcgctccagtcttcagtagggaattgctgaataggcacagagggcacctgtacaccttcagaccagtctgcaacctcaggctgagtagcagtgaactcaggagcgggagcagtccatcaccctgaaattcctccttggtcactgccttctcagcagcagcctgctcttctttttcaatctcttcaggatctctgtagaagtacagatcaggcatgacctcccatgggtgttcacgggaaatggtgccacgcatgcgcagaacttcccgagccagcatccaccacattaaacccactgagtgagctc

SEQ ID NO: 408 - DNA, 386 bp, Homo sapiens
ggcttagcggataacaatttcacacaggaggtactaagggtactgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatatatttaagcctttggatttaaagcctgttgaggctagagttaggaggcagattgatagtaggattataataaacattaaataatcaaaaaaaaaaaacccctt

SEQ ID NO: 409 - DNA, 539 bp, Homo sapiens
  misc_feature 102, 198, 226, 261, 446, 484: n = A,T,C or G
caaagccagaaaatgcacaaggaggaacatgaggtggctgtgctgggggcaccccccagcaccatccttccaaggtccaccgtgatcaacatccacagcganacctccgtgcccgaccatgtcgtctggtccctgttcaacaccctcttcttgaactggtgctgtctgggcttcataccattcgcctattccgtgaantctagggacaggaaaatggttggcgacntgaccggggcccaggcctatgcctccaccgccaantgcctgaacatctgggccctgattctgggcatcctcatgaccattggattcatcctgttactggtattcggctctgtgacagtctaccatattatgttacaaataatacgggaaaaacggggttactagtagccgcccatagcctgcaacctttgcactccactgtgcaatgctggccctgcacnctggggctgttgcccctgcccccttggtcctgccctanatacagcagtttatacccacacacctgtctacagtgtcattcaataaaattgcac

SEQ ID NO: 410 - DNA, 477 bp, Homo sapiens
aagaggaaaacccggtaatgatgtcggggttgagggataggaggagaatgggggataggtgtatgaacatgagggtgttttctcgtgtgaatgagggttttatgttgttaatgtggtgggtgagtgagccccattgtgttgtggtaaatatgtagaggagtatagggctgtgactagtatgttgaatcctgtaagtaagagagtgatatttgatcaggaaaacgtggttactagcacagaaagttctcccagtaagttaataatggggggtaaggcgaagttaaccaagcttgctaaaaatcatccaaaactattaatgggaattagaatttgaaatccctgaaaaaagaataagatgcactgtaatgcttccgtatttgagtttgctaagccaatattaatggaatttaatcccctggccaatataaaatacgccccgtaacctcagggttttgaataaaatgtgttacacaaggc

SEQ ID NO: 411 - DNA, 286 bp, Homo sapiens
  misc_feature 8, 116, 118: n = A,T,C or G
agttgganaaaccttttattggcacaggcattccttgttaacttgacagggtgaagctaatttttcaaaaacagtaaaagctggtttctcctaaactattttccttgtggtagtananatcagtgggtcagaaacaactcctgaccacttggtttccttttgagccgcgtcattaggaggcaatctgtaaaactagcacaggtctcccgctgttccactggctcacccacatgattagcagagtgcacgaaaaaaataaaacttctattaaagaatcatgctgaag

SEQ ID NO: 412 - DNA, 461 bp, Homo sapiens
ccgttgctgtcggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcgcgcctgtaagcccagcactttgggaggccaaggtgggaggatgacaaggtcaggagttcaggaccagcctggccaacatgctgaaacctcacctctactgaaaatacaaaaattagctgggcatggtggcacatgcctgtaatcccagctacttgggaggctgaggcaggagaatcgcttggacccgggaggcggaggttgcagtgagccaagacagtgccagtgcactccagcctcggtgacagcgcaaggctccgtctcaataattaaaaaaaaaaaaa

SEQ ID NO: 413 - DNA, 382 bp, Homo sapiens
  misc_feature 319: n = A,T,C or G
gcggcacgagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagaatactttgccatcaaggccctcaagaaggatgtggtcctgatcgacgacgacgtggagtgcaccatggttgagaagcgggtgctgacacttgccgcagagaatccctttctcacccacctcatctgcaccttncagaccaaggaccacctgttctttgtgatggagttcctcaacgggggggacctgatgtaccac

SEQ ID NO: 414 - DNA, 579 bp, Homo sapiens
ttccgttgctgtcgcgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgt

SEQ ID NO: 415 - DNA, 421 bp, Homo sapiens
attccgttgctgtcggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacgcgggaggcccgatcaccacaaccaaacaaacggcattcgccctcaccacggcctcgagctcctcag

SEQ ID NO: 416 - DNA, 436 bp, Homo sapiens
ggcacgagagacaatctcctgaggcagttggctcataaggtcctttacaagctgaataaccctaagttcaatgatccgcacgtcaagaccaacctgctcctgcaggctcacttgtctcgcatgcagctgagtgctgagttgcagtcagatacggaggaaatccttagtaaggcaatccggctcatccaggcctgcgtggatgtcctttccagcaatgggtggctcagccctgcttggcagctatggaactggcccagatggtcacccaagccatgtggtccaaggactcatacctgaagcagctgccacacttcacctctgagcatatcaaacgttgcacagacaagggagtggagagtgttttcgacatcatggagatggaggatgaagaacggaacgcgttgcttcagctgactgacagccagattgcagatgt

SEQ ID NO: 417 - DNA, 617 bp, Homo sapiens
ggcacgagccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatact

SEQ ID NO: 418 - DNA, 327 bp, Homo sapiens
ggcacgaggagactgctcctgccgctcccgctgccgcgcctcctgcggagaaggcccctgtaaagaagaagacggccaaaaaggctgggggtacgcctcgtaaggcgtccggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaaca

SEQ ID NO: 419 - DNA, 507 bp, Homo sapiens
ccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatct

SEQ ID NO: 420 - DNA, 388 bp, Homo sapiens
ggcacgagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaaaaaaaaaaaaagcctttaaaactatagggagtcgttttacgtaaatcca

SEQ ID NO: 421 - DNA, 578 bp, Homo sapiens
ggcacgaggaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgt

SEQ ID NO: 422 - DNA, 496 bp, Homo sapiens
  misc_feature 386: n = A,T,C or G
aagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagttcagccgaccagagggaantgaggaggaagatgatgtttgggaacagggagcagggcctgtttgggaaattcaaggaaatttgggaggtggattattttatttttcttcattgattgccaaagacccca

SEQ ID NO: 423 - DNA, 505 bp, Homo sapiens
  misc_feature 85, 430, 444, 478: n = A,T,C or G
gtcagcgcatcttcttttgcgtcgccagccgagccacatcgctgagacaccatggggaaggtgaaggtcggagtcaacggatttngtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccagggagcgagatccctccaaaatcaagtggggcgatgctggcgctgagtacgtcgtggagtccactgggcgtcttcaccaccatgggagaaggctggggctcatttgcaggggggagccaaaagggtcattcatcttttgccccttntgctgacggccccngtttcgttcatgggtgttgaaccatgaggagttntgacaaacagcctcaagatcatcagca

SEQ ID NO: 424 - DNA, 550 bp, Homo sapiens
tgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcgagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttg

SEQ ID NO: 425 - DNA, 474 bp, Homo sapiens
tgtggaactttcctaacgttgaatagccctacagatgcttctcttgctgcgggttttcttttgttagtggtctgaaataattattttcctgttctattaatacatagtgtattttgcacaaaaaaattaacctggtcaatagtgattaccagaatatatattaataatcttggcaattattgacattaattatgaaacattctatcccacgttaattctacattattcttcactgaaactcacctactgcaaatattgactttctgtaaatgttattaaaatatccagtgagctctttaaaaagactcagtattatttcaagactatttttgacgtaattctatccttttaaaatatactacagacctactgggcttaaaagaaccccagtaccgactaagcaaataagcaaaagacatgttggaaatgtagtatagtacttgaaacagtcactatcatagggataattggtgc

SEQ ID NO: 426 - DNA, 745 bp, Homo sapiens
  misc_feature 2, 3, 4, 5, 6, 7, 13, 15, 18, 19, 20, 21, 22, 23, 24, 25,26, 27, 28, 29, 30, 31, 32, 33, 34, 35, 36, 37, 38, 39,40, 41, 42, 43, 44, 45, 46, 47, 48, 49, 50, 51, 52, 53,54, 55, 56, 57, 58, 59, 60, 61, 62, 63, 64, 65, 66, 67,68, 69: n = A,T,C or G
  misc_feature 70, 71, 72, 73, 74, 75, 76, 77, 78, 79, 80, 81, 82, 83, 84,85, 86, 87, 88, 89, 90, 91, 92, 93, 94, 95, 96, 97, 98,100, 101, 102, 103, 104, 105, 106, 107, 108, 109, 110, 111,112, 113, 114, 115, 116, 117, 118, 119: n = A,T,C or G
gnnnnnntaaagnanacnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnacttcccacacaggtttgttgtaaaaattaagtgagctaatgtgtataaaatacttcagtgctgaataaatgttggcttttattatatattgttaaaaaacaacacaggctgggtatgatagctcacgcctataatcctagcatttagggaggccaaggcaggaggattgcttgagtccaggggtttgagaccagcctgggcaacatagtgagaccctatctctacaaaataaaataaattagttgggcatggtggcacatgcctgtagtcccagctactcaggaggctgaggtgggaggattgcttgagcccaggaggtagaggttgcagtgagctgtgatcacaccactgcactccagcgtcggtgacggagtgagaacctatctcaaacaaacaaacaaaaaaacccaaaacaaacaaaaaaatccagtaaagacagagattcctaaaattctacaattctaaaaaccagtagggctcactgaatataagagaggcaagcaaaaaattactccaatattttgagtttgggtaacctggaatatgggtcatttattgagtaaatagttactgagtcctaactatgtgccacacactgggttaacacttggcactgtctcttatg

SEQ ID NO: 427 - DNA, 328 bp, Homo sapiens
aggtacaaaccaatagctcctattctggaaggttttctttttatttaaaaaaaattcaaacaaggttaaaagtcaagcaagaagggaagagagaaactgggttctgagaaaaaaatgtgccagtataaaataaactcctaaatgcgtgcttgtcatcctctagttttttttttaagttgaatttcttttccactgtaacttaaaatttgagattgaggtttgcggtccaaaacataccctcagcagatacagtgactaactggaaagtgcagttgttcaagggctgtcatgctcaatcacctaaagctataatttgtttgatatatta

SEQ ID NO: 428 - DNA, 367 bp, Homo sapiens
gcccttagcgtggtcgcggccgaggtacagggaaggcctttcgggcagggcacatggttcactgccccatgacgtgataccttgaagcacaccattacagacaagtgggcccccagaatcacccgagcaggtgcttttgccccctgtccagcgtccagcacacagcatgaacttggtcaccttctgagggtgaacttgcgcacacacgtcattggaaataacatggaggtccacacactgaagtttctttggggtcaagaactcctctggttcaatgctgccccagcctgaggcgtagcaggtggtccccactgctggctcctgggtgggcaggtccatgaccttcacagcatccgtgagctcggca

SEQ ID NO: 429 - DNA, 745 bp, Homo sapiens
  misc_feature 2, 3, 4, 5, 6, 9, 11, 12, 13, 14, 15, 16, 17, 18, 19, 20,21, 22, 23, 24, 25, 26, 27, 28, 29, 30, 31, 32, 33, 34,35, 36, 37, 38, 39, 40, 41, 42, 43, 44, 45, 46, 47, 48,49, 50, 51, 52, 53, 54, 55, 56, 57, 58, 59, 60, 61, 62,63, 64: n = A,T,C or G
  misc_feature 65, 66, 67, 68, 69, 70, 71, 72, 73, 74, 75, 76, 77, 78, 79,80, 81, 82, 83, 84, 85, 86, 87, 88, 89, 90, 91, 92, 93,94, 95, 96, 97, 98, 99, 100, 101, 102, 103, 104, 105, 106,107, 108, 109, 110, 111, 112, 113, 114, 115, 116, 117, 118: n = A,T,C or G
  misc_feature 119, 120: n = A,T,C or G
gnnnnnttnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccacccttttttttttttttttttggctt

SEQ ID NO: 430 - DNA, 421 bp, Homo sapiens
ggcacgaggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagaaagacctgagctgtcttccttggcactgcctatggaggtgacacccatctcctccatcatggccatcctgagaccgctcgcgaagcccaagatcatcaaaaagagcaccaagttcactgggaaccagtcagactgatatgtcaaaattaagggtaactggtggaaacacagaggtattaacaacagggttcatagaaggtttgagggccagatctatgcccaacattggttatgggagaaacataaagacaaagcacatactgctggtgagca

SEQ ID NO: 431 - DNA, 322 bp, Homo sapiens
ggcacgagatgaatacagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggc

SEQ ID NO: 432 - DNA, 393 bp, Homo sapiens
ggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttctacgaggacccagctgggggcaaacactgtgaggaagcagacacctctactcccgacaggacatgctggagtctggc

SEQ ID NO: 433 - DNA, 568 bp, Homo sapiens
ttccgttgctgtcgctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccg

SEQ ID NO: 434 - DNA, 256 bp, Homo sapiens
gccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgaaaaaaaaaaaaaaaaaaaactccgggggccgttttt

SEQ ID NO: 435 - DNA, 380 bp, Homo sapiens
atgtggagtgtatgttcttttcacagtaatatatcccttttgtaacttcacttggttattttattgtaaatgagtccaaaattcttaatttaagagattgtatgtaatatttatttcattaattcctttccttgggtacgttaattatgaaagattgcatgatttcttgacagaaatcgatcttgatgctgtggaagtagttcgaggaacatcctatgagttctcttagaatgtataaaggttgtagcccatccaacttcaaagaaaataatgaccacatactttgcaatcatgctgacatgtggcatgcttttctaattccaactttataaactagcaaaaaagtgtttgcttattccaccagttctactgtgacatac

SEQ ID NO: 436 - DNA, 255 bp, Homo sapiens
ggcacgaggcgagatgacgaagggaacgtcatcgtttggaaagcgtcgcaataatacgcacacgttgtgccgccgctgtggctctaaggcctaccaccttcagaagtcgacctgtggcaaaagtggctaccctgccaagcgcaagagaaagtataactggagtgccaaggctaaaagacgaaataccaccggaactggtcgaatgaggcacctaaaaattgtataccgcagattcaggcatggattccgtgaagg

SEQ ID NO: 437 - DNA, 300 bp, Homo sapiens
atttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatt

SEQ ID NO: 438 - DNA, 432 bp, Homo sapiens
cttctctcaagacccaatccattcgtattccgttgacttgggagagtttgccaggtaaaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaaggaaaaaatttctttcaattggtcttcccattgcaggtactgatatttctcttttt

SEQ ID NO: 439 - DNA, 319 bp, Homo sapiens
tccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcatgtctact

SEQ ID NO: 440 - DNA, 423 bp, Homo sapiens
ggcacgagatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagacaccctcccgcctgtcggcccgtagatatatcaagggtgttatgggcccagctttggggggcc

SEQ ID NO: 441 - DNA, 502 bp, Homo sapiens
ggcacgagggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactacgatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaaaaaaaaaaaaaaaaaaaactcgagcctctagaactatagtgagtcgtatta

SEQ ID NO: 442 - DNA, 407 bp, Homo sapiens
cgcagtcttcgccaccatgccgccctacaccgtggtctatttcccagttcgaggccgctgcgcggccctgcgcatgctgctggcagatcagggccagagctggaaggaggaggtggtgaccgtggagacgtggcatgagggctcactcaaagcctcctgcctatacgggcagcttcccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttg

SEQ ID NO: 443 - DNA, 573 bp, Homo sapiens
ggcacgagctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatata

SEQ ID NO: 444 - DNA, 230 bp, Homo sapiens
cttgataagccttggacagaaccctccaccccgcagaccaagcgtcgtgtgtgtgtgggagagaaagacgcccgtgttgagctcatggagaccccggtgtgtccgctctttagcaatataacctacccagtgcgtgccgagcaagcttggtggggaagggactagagctgggcaagtactggcctggcacccgcagccgtctccctttcgtggaccaaggaggtgtttgc

SEQ ID NO: 445 - DNA, 403 bp, Homo sapiens
ggcttagcggataacaatttcacacaggagttgcaccataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctctgaaaaaaaaaaa

SEQ ID NO: 446 - DNA, 360 bp, Homo sapiens
actatagggctttttttttttcgactttttaaagaagtaagcctttatttccttgttttgcaaataaaactggctaagttggttgctttttggggattagtcaaagagaccaaatcccatatcctcgtccgactcctccgacttttccttggcttcaaccttagctggggctgcagcagcagcaggagcagctgtggtggcagcagccacaggggcagcagccacaaaggcagatggatcagccaagaaggccttgaccttttcagcaagtgggaaggtgtaatccgtctccacagacaaggccaggactcgtttgtacccgttgatgataaaatggggtactgatgcaacagttgggta

SEQ ID NO: 447 - DNA, 587 bp, Homo sapiens
ttccgttgctgtcgcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcgcggctactacaatcagagcgaggccgggtctcacaccctgcagtggatgcatgctgcgagctggggcccgacaggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtgga

SEQ ID NO: 448 - DNA, 396 bp, Homo sapiens
gacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccaggtgagctcccaacagggttttcttaatgctcaaatggtcgcccaacgcagcaaagagctgctaagtcatcacttccgacaacagagggtgg

SEQ ID NO: 449 - DNA, 390 bp, Homo sapiens
ccaacatggtgagtcttactgttgcgggctccggggccgtcgaccatgccgctcgacttccacctccgctgggaagctgaggcgccgaacggctcccagagggtcccgggaagcgcatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatggg

SEQ ID NO: 450 - DNA, 1028 bp, Homo sapiens
  misc_feature 1, 2, 3, 5, 6, 7, 8, 9, 10, 11, 12, 14, 15, 16, 17, 18, 19,20, 21, 22, 23, 24, 25, 26, 27, 28, 29, 30, 31, 32, 33,34, 35, 36, 37, 38, 39, 40, 41, 42, 43, 44, 45, 46, 47,48, 49, 50, 51, 52, 53, 54, 55, 56, 57, 58, 59, 60, 61,62: n = A,T,C or G
  misc_feature 63, 64, 65, 66, 67, 68, 69, 70, 71, 72, 73, 74, 75, 76, 77,78, 79, 80, 81, 82, 83, 84, 85, 86, 87, 88, 89, 90, 91,92, 93, 94, 95, 96, 97, 98, 99, 100, 101, 308, 309, 310,311, 312, 313, 314, 315, 316, 317, 318, 319, 320, 321, 322: n = A,T,C or G
  misc_feature 619, 620, 621, 622, 623, 624, 625, 626, 627, 628, 629, 630,631, 632, 633, 634, 635, 636, 637, 638, 639, 640, 641, 642,643, 644, 645, 646, 647, 648, 649, 650, 651, 652, 653, 654,655, 656, 657, 658, 659, 660, 661, 662, 663, 664, 665: n = A,T,C or G
  misc_feature 666, 667, 668, 669, 670, 671, 672, 673, 674, 675, 676, 677,678, 679, 680, 681, 682, 683, 684, 685, 687, 688, 689, 693,697, 698, 699, 700, 705, 707, 708, 709, 710, 711, 712, 713,714, 725, 732, 755, 773, 777, 791, 792, 795, 799, 804: n = A,T,C or G
  misc_feature 816, 827, 831, 834, 836, 837, 840, 851, 871, 876, 877, 878,879, 886, 895, 896, 909, 922, 924, 927, 938, 939, 941, 943,944, 945, 946, 947, 955, 957, 962, 968, 981, 982, 983, 987,988, 997, 998, 999, 1017, 1028: n = A,T,C or G
nnngnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcggggctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggcnnnnnnnnnnnnnnnaacattggttatggaagcaacaaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcaaaaaaaaaannnnnnnnnnnnnnnnnnnnnnnnnnnnnnnnnnnnnnnnnnnnnnnnnnnnnnnnnnnnnnnnnnnannnaaancccnnnnaaaanannnnnnnnaaaaaggcttnttttaangggcaaattgggaaacctttttnattcaaaaatggcttttnccanggactggggaccannttncccnggggnccaaaattgggntttcctttaancccnttncnnaangggaatttttncccttgggccttgaaaaacnaagcnnnnaaaaagncccttgggnnggaaacccctttngggggaatttccncnccnttgggggggcnntntnnnnngggacccnanttggncccaanttttggggaaaannngggnnaaaaagggnnnccctgggggaaaatgttnccccccaaatn

SEQ ID NO: 451 - DNA, 1026 bp, Homo sapiens
  misc_feature 5, 6, 7, 8, 10, 20, 21, 22, 23, 24, 25, 26, 27, 28, 29, 30,31, 32, 33, 34, 35, 36, 37, 38, 39, 40, 41, 42, 43, 44,45, 46, 47, 48, 49, 50, 51, 52, 53, 54, 55, 56, 57, 58,59, 60, 61, 62, 63, 64, 65, 66, 67, 68, 69, 70, 71, 72,73: n = A,T,C or G
  misc_feature 74, 75, 76, 77, 78, 79, 80, 81, 82, 83, 84, 85, 86, 87, 88,89, 90, 91, 92, 93, 94, 95, 96, 97, 98, 99, 100, 101, 102,103, 104, 105, 106, 107, 552, 553, 554, 555, 556, 557, 558,559, 560, 561, 562, 563, 564, 565, 566, 567, 568, 569: n = A,T,C or G
  misc_feature 570, 571, 572, 573, 574, 575, 576, 577, 578, 579, 580, 581,582, 583, 584, 585, 586, 587, 588, 589, 590, 591, 592, 593,594, 595, 596, 597, 598, 599, 600, 601, 602, 603, 604, 605,606, 607, 608, 609, 610, 611, 612, 613, 614, 615, 616: n = A,T,C or G
  misc_feature 617, 618, 619, 620, 621, 622, 623, 624, 625, 626, 627, 628,629, 630, 631, 632, 633, 634, 635, 636, 637, 638, 639, 640,641, 642, 643, 644, 645, 646, 647, 648, 649, 650, 651, 652,653, 654, 655, 656, 657, 658, 659, 660, 661, 662, 663: n = A,T,C or G
  misc_feature 664, 665, 666, 667, 668, 669, 670, 671, 672, 673, 674, 675,676, 677, 678, 679, 680, 681, 682, 683, 684, 685, 686, 687,688, 689, 690, 691, 692, 693, 694, 695, 696, 697, 698, 699,700, 701, 702, 703, 704, 705, 706, 707, 708, 709, 710: n = A,T,C or G
  misc_feature 711, 712, 713, 714, 715, 716, 717, 718, 719, 720, 721, 722,723, 724, 725, 726, 727, 728, 729, 730, 731, 732, 733, 734,735, 736, 737, 738, 739, 740, 741, 742, 743, 744, 745, 746,747, 748, 749, 750, 751, 753, 777, 794, 822, 826, 830: n = A,T,C or G
ggagnnnntnaatcatacgnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattttgtgcacacaaaatgtgcgcacacacacacacacacacacacagacactcctgcacatggcctgttaaagaactacaagggaggtgggacgcgggaaagtgtatggtgtgggtttgcatcgtctcatcattgattcttctcatatttttctctgattagagaaactaaagagaattttgtgagaaaggcttgaaagttaatgagttacttctaccaaagtgattacaagcagaaatcctcagatgctgtagagatgctgacccacacatccttagctcaaggaagcccctcgcattagtcaccttcagccatcagcagcctccaccattaaccccagtgtgctgtataaaaaatactttctacatgtgcccaaatttgaaaagttaggaagcactgatttcaaagcaaatcattcacatttgaactgtcttcagtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnactggcgtaattaaccaaaaaggnccggaccgaatcggccntttccaacaagttgggccaacctgaatnggcnaaanggcccccccctgtaaccggngccattaaacccccgncgggnnnntnggggtacccccaacggggaccggttaacttggccanggccttaaggcccggtccttttggtttnttncctttcntttttngcccntttnccnggnttttcccgnaaagntntaaaaagggggggtccccntttaggggtcccaataaagg

SEQ ID NO: 452 - DNA, 393 bp, Homo sapiens
  misc_feature 393: n = A,T,C or G
ggcacgaggtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcatctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggn

SEQ ID NO: 453 - DNA, 469 bp, Homo sapiens
tgatgccagcagctaggactgggagagataggagaagtaggactgctgtgattaggacggatcagacgaagaggggcgtttggtattgggttatggcagggggttttatattgataattgttgtgatgaaattgatggcccctaagatagaggagacacctgctaggtgtaaggagaagatggttaggtctacggaggctccagggtgggagtagttccctgctaagggagggtagactgttcaacctgttcctgctccggcctccactatagcagatgcgagcaggagtaggagagagggaggtaagagtcagaagcttatgttgtttatgcggggaaacgccatatcgggggcaccgattattaggggaactagtcagttgccaaagcctccgattatgatgggtattactatgaagaagattattacaaatgcatgggctgtgacgataacgttgtagatgtggtc

SEQ ID NO: 454 - DNA, 285 bp, Homo sapiens
tccgttgctgtcgcaaggacctggctatggtggcttcagacatgatggttcgtcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctc

SEQ ID NO: 455 - DNA, 53 bp, Homo sapiens
tgactacctcagcctgtcagccatcatcgatggcaagatcttctgcgtgcacg

SEQ ID NO: 456 - DNA, 405 bp, Homo sapiens
gcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggct

SEQ ID NO: 457 - DNA, 607 bp, Homo sapiens
ggcacgagctcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaaccgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaa

SEQ ID NO: 458 - DNA, 459 bp, Homo sapiens
ggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggc

SEQ ID NO: 459 - DNA, 537 bp, Homo sapiens
  misc_feature 7, 91, 327, 397, 470: n = A,T,C or G
ctcgcancagcgatgagacaagaccgacctcaaccccgacaacctgcagggcggcgacgactggaccccaactacgtgctgagctcgcggngtgccacgggccgcagcatccgtggcttctgcctccccccgcactgcagccgcggggagcccggccatcgagaagctcgcggtggaagccctgtccagcctggacggcgacctggcgggccgatactacgcgctcaagagcatgacggaggcggacagcagcagctcatcgacgaccacttcctcttcgacaagcccgtgtcgcccctgctgctggcctcgggatggcccggactngcccgacgcccgcggtatctggcacaatgacaataagactttctggtgtgggtcaacgaggaggaccacntgcgggttcattttccattgcagaaggggggcaacatggaaggaggtttttcaaccgtttttgcaccggcttnaaccagatttgaaatttttttcaattttaaggattttgagtttatgttggaaccttaattgggttat

SEQ ID NO: 460 - DNA, 502 bp, Homo sapiens
  misc_feature 30, 342, 396, 429, 438, 452, 487: n = A,T,C or G
tggccccgatgggatggagcccgaagcgtncatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatgggcactagggagantacatggggcgcctcctgttcacgcctgttattcgggggcaccaacgtgcgtgnttgaggttgcaggaaattgcagatgggaagttncccacatcntcgtggggtacccntgggcctgtttttttgatatggtttaacccgaganaactttttcccccaa

SEQ ID NO: 461 - DNA, 392 bp, Homo sapiens
caaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagaagctgctgaacaattgggaaagaatgttaagttagtggagcgtttggtggaatggtgtgaaacccaaaat

SEQ ID NO: 462 - DNA, 124 bp, Homo sapiens
tatgattcacacaagtttgaggatgctggggagagggggagggggctgaggtggtgttctgttggttacaagaaagttataccatttaaagctggcaccagagacccgatagggacttattaac

SEQ ID NO: 463 - DNA, 256 bp, Homo sapiens
gagagagagagagagagagagagagagagagagagagagagagagagagagagagagagagagagagagagagagagagagagagagagagagagagagagagagagagagagagagagaggagaagtctcgcgatagccagccgcggctgcccttgcgcttcccgagctggcggggtccgtggtgcgggatcgagattgcgggctatggcgccgaaggtttttcgtcagtactgggatatccccgatggcaccga

SEQ ID NO: 464 - DNA, 511 bp, Homo sapiens
ggcacgaggttcaggccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtc

SEQ ID NO: 465 - DNA, 485 bp, Homo sapiens
ggcacgagactgccccccaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggg

SEQ ID NO: 466 - DNA, 493 bp, Homo sapiens
atctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaggagggactttctctggaatttcctgatatgaccaagaaagcttcttatcaaaagaagcacaatt

SEQ ID NO: 467 - DNA, 463 bp, Homo sapiens
acccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggacttcgaggtgggcgcccgcaaggtggtgtcctgcctgtccacctgtatcttccctgacaagacgacctacccgatagatgagaccatgatccacaatgggc

SEQ ID NO: 468 - DNA, 405 bp, Homo sapiens
cgttgctgtcgctgctccgaggttgaaatagactgcctgacgggggatcataagaggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatg

SEQ ID NO: 469 - DNA, 432 bp, Homo sapiens
gaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacag

SEQ ID NO: 470 - DNA, 419 bp, Homo sapiens
ccctgaggaggcacagcgccttctgccacctctgggcacggcctcaaggtaatgaggctaggaggttttttctgaccaatagctgagttcttgggagaggagcagctgtgcctgtgtgattccttagtgtcaagtgggctctgggctggggtcggccctgggcaggcttctcctgcaccttttgtctgctgggctgagggacacgagggcaaccctgtgacaatggcaggtagtgtgcatccgtgaatagcccaatgcgggggttgctcatggagcatactgaggccgtgcagcagggagccccatgcccctgggtcgtgagcttgcctgcgtatggcgtggtgtcatggagcctcatgcccctgggtcgtgagctcgcctgagtatggggtggtgtcatggaaccgcatacccctggg

SEQ ID NO: 471 - DNA, 498 bp, Homo sapiens
ttcgtttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggc

SEQ ID NO: 472 - DNA, 517 bp, Homo sapiens
acgagattttaacagctttacatgtaatattcatatataaaaaactttaagtgcttttctccaatttaaaaatctaaagaattcaaaaataaggcattcaatatttgaaaaaagtacagatttacaaaatgtgtatattctgtcatgaaaactccacaccaacattatacacttggaaaaaaatacaaacaggatatattacaaatttatgcagcaataacttagttcacaccatgcaataaaaagtacattaatcaagatacacaagcttttgtaggttctaaactgaaggacttttttctttttttttctgcagaatccttaaaacctgtggcacttaaaatttgttagcctttctaatgagaggtaaattatacacaacaatgatgaaaaagattaacagaccagttgtctattatgaatcattccagctttgttcaacaatggccgaaactcttttctcatattctcgtttgttttcctgataaagctgtgctgcctggctattggctggact

SEQ ID NO: 473 - DNA, 168 bp, Homo sapiens
gccatctatgcctcacagactgagcaagagtatctaaagatagaaaaaggagacggtggctcagggagtaaaggaaggccagttgagcaaacagaagtgttcctctgcatttcaaaaccttcttcctttctatagccctgtggtggaagattttattaaaatcctacg

SEQ ID NO: 474 - DNA, 404 bp, Homo sapiens
cgttgctgtcgcaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatag

SEQ ID NO: 475 - DNA, 374 bp, Homo sapiens
aactccgtgctgtcgaggaaagctgacgtgggagggcggaccctgagctactttggagacataatgcccttgctgatgggggagagacgacgcactggcctttttgtacgcctgaggtcagggggagcgggtgtaagacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttcc

SEQ ID NO: 476 - DNA, 391 bp, Homo sapiens; identical to SEQ ID NO: 144

SEQ ID NO: 477 - DNA, 357 bp, Homo sapiens
gcaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgtaagtgtcaagtgggaggatactgcccccttgtgggggccagacgggtcggacacggctgtgccccatctggggccaacacca

SEQ ID NO: 478 - DNA, 503 bp, Homo sapiens
tagttggtgaagatacagaacgtgccaactctatgggcctgtttctgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctcatgatggatgccaccaatatgccagctgtcaaagccatcatatatcagtatatggaagagatttatcatagaatccccgactcagacccatcttctagcaaaacaaggcagatcatc

SEQ ID NO: 479 - DNA, 484 bp, Homo sapiens
tatttcctgattttaaaaatcgtcaccatcatagacctcctggcttctcttgtatctgtgttctaatggctcccagcagtgccttcacacagcccctttattccccttcttgtgcctgcccatgagcctgagtgtgacagatcaattagctttgtccctccaaactgtgggagcaggactagactcttctggcaggcagagagctcctcctcggccagtgttcgagcctggtccaccactcctcagttcttcttgctcttggcttttgtggccttggcatccagcgtgctctgggcatgagtgaggtgcttcacagcatcaagcacaaggactccaggcagcaccagccacagggcattcatgaagacaaagtaaaaccagaagtagagagggtggcccagctctccgtgctggaatccgtcgcggtgctctgtcaggaagtagagcacatccccatagatctggcccacagagaccacaagct

SEQ ID NO: 480 - DNA, 509 bp, Homo sapiens
ggcacgaggttaagacctgcaataatccagaatggctactctgatctatgttgataaggaaaatggagaaccaggcacccgtgtggttgctaaggatgggctgaagctggggtctggaccttcaatcaaagccttagatgggagatctcaagtgtcaacaccacgttttggcaaaacgttccatgccccaccagccttacctaaagctactagaaaggctttgggaactgtcaacagaactacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttc

SEQ ID NO: 481 - DNA, 530 bp, Homo sapiens
ggcacgaggcgacccggcggcgggacaggcttgctgcttccttctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaagagcccacctgaatgaccttgaaaatattattccatttcttggaattggcatcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttag

SEQ ID NO: 482 - DNA, 414 bp, Homo sapiens
ggcttagcggataacaatttcacacaggattttggctccaacattccttttggcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgtttttttttttcattgtcaacaggggg

SEQ ID NO: 483 - DNA, 350 bp, Homo sapiens
aatcctctctcaaggacttcaaactctactcccactaatagctttttgatgacttctatcaagcctcgctaacctcgccttaccccccactattaacctactgggagaactctctgtgtagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacgccctcatgttcatacacctatcccccattctcctcctatccctcaaccccgacatcattaccgggttttcctc

SEQ ID NO: 484 - DNA, 572 bp, Homo sapiens
actttttaaagaagtaagcctttatttccttgttttgcaaataaaactggctaagttggttgctttttggtgattggtcaaagagaccaaatcccatatcctcgtccgactcctccgactcttccttggcttcaaccttagctggggctgcagcagcagcaggagcagctgtggtggcagcagccacaggggcagcagccacaaaggcagatggatcagccaagaaggccttgaccttttcagcaagtgggaaggtgtaatccgtctccacagacaaggccaggactcgtttgtacccgttgatgatagaatggggtactgatgcaacagttgggtagccaatctgcagacagacactggcaacattgcggacaccctccaggaagcgagaatgcagagtttcctctgtgatatcaagcacttcagggttgtagatgctgccattgtcgaacacctgctggatgaccagcccaaaggagaagggggagatgttgagcatgttcggcagcgtggcttcgctggctcccactttgtctccagtcttgatcagctgcacatcactcaggatttca

SEQ ID NO: 485 - DNA, 563 bp, Homo sapiens
  misc_feature 436, 457, 550: n = A,T,C or G
tgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgtctttgtggctgctgcccctgtggctgctgccaccacagctgctcctgctgctgctgcagccccagctaangttgaagccaaggaagagtcngaggagtcggacgaggatatgggatttggtctctttgactaatcaccaaaaagcaaccaacttagccagttttatttgcaaaacaaggaaatnaaggcttacttct

SEQ ID NO: 486 - DNA, 411 bp, Homo sapiens
caagtagctttccacatttgtcacagaaatcagaggagagatggtgttgggagccctttggagaacgccagtctcccaggccccctgcatctatcgagtttgcaatgtcacaacctctctgatcttgtgctcagcatgatctttaatagaagttttattttttccgtgcactctgctaatcatgtgggtgagccagtggaacagcgggagacctgtgctagttttacagattgcctcccttatgacgcggctcaaagaaccaagttgtcagattgttccgacccactgatctcctactaccacaagagaatagtttagaataaccagctttactgttttgaaattacagctcccccctgtccatttaacaagatgcccgtgcccaataaggttcctccccactttgaattc

SEQ ID NO: 487 - DNA, 335 bp, Homo sapiens
ccgttgctgtcggcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaa

SEQ ID NO: 488 - DNA, 396 bp, Homo sapiens
cgttgctgtcgggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcct

SEQ ID NO: 489 - DNA, 345 bp, Homo sapiens
  misc_feature 309, 315, 340: n = A,T,C or G
gcggcacgagtcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaangcgctngaccatcacctccagggagatccanacggc

SEQ ID NO: 490 - DNA, 1092 bp, Homo sapiens
  misc_feature 2, 4, 5, 6, 7, 8, 9, 11, 12, 13, 14, 15, 16, 17, 18, 19,20, 21, 22, 23, 24, 25, 26, 27, 28, 29, 30, 31, 32, 33,34, 35, 36, 37, 38, 39, 40, 41, 42, 43, 44, 45, 46, 47,48, 49, 50, 51, 52, 53, 54, 55, 56, 57, 58, 59, 60, 61,62, 63: n = A,T,C or G
  misc_feature 64, 65, 66, 67, 68, 69, 70, 71, 72, 73, 74, 75, 76, 77, 78,79, 80, 81, 82, 83, 84, 85, 86, 87, 88, 89, 90, 91, 92,93, 94, 95, 96, 97, 98, 99, 100, 101, 102, 348, 349, 350,351, 352, 353, 354, 355, 356, 357, 358, 359, 360, 491, 492: n = A,T,C or G
  misc_feature 493, 494, 495, 496, 497, 498, 499, 500, 501, 502, 503, 504,505, 506, 507, 508, 509, 510, 511, 512, 513, 514, 515, 516,517, 518, 519, 520, 521, 522, 523, 524, 525, 526, 527, 528,529, 530, 531, 532, 533, 534, 535, 536, 537, 538, 539: n = A,T,C or G
  misc_feature 540, 541, 542, 543, 544, 545, 546, 547, 548, 549, 550, 551,552, 553, 554, 555, 556, 557, 558, 559, 560, 561, 562, 563,564, 565, 566, 567, 568, 569, 570, 571, 572, 573, 574, 575,576, 577, 578, 579, 580, 581, 582, 583, 584, 585, 586: n = A,T,C or G
  misc_feature 587, 588, 589, 590, 591, 592, 593, 594, 595, 596, 597, 598,599, 600, 601, 602, 603, 604, 605, 606, 607, 608, 609, 610,611, 612, 613, 614, 615, 616, 617, 618, 619, 620, 621, 622,623, 624, 625, 626, 627, 628, 629, 630, 631, 632, 633: n = A,T,C or G
  misc_feature 634, 635, 636, 637, 638, 639, 640, 641, 642, 643, 644, 645,646, 647, 648, 649, 650, 651, 652, 653, 654, 655, 656, 657,658, 659, 660, 661, 662, 663, 664, 665, 666, 667, 668, 669,670, 671, 672, 673, 674, 675, 676, 677, 678, 679, 680: n = A,T,C or G
gngnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgaaccaaggagggagggtcttcctttggcatgggatggggatgaagtaaggagagggactggannnnnnnnnnnnngattcactatggggggaggtgtattgaagtcctccagacaaccctcagatttgatgatttcctagtagaactcacagaaataaagagctgttatactgcgaaaaaaaaaaaaaaaaaaaaaaaaaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacgtgacccgntacactttgcccagngnccttaacgcccggttccttttgctttcttncctttcctttttttgccccgtttnnccgggtttttccccgttaaagctnttaaatcggggggcttncccnttttaggggttcccnaattaanggctttacngggncctttgaacccccaaaaaaantttnnttttngggggggaagggttcncctagggggccatttncccctnnaaaaaagggtttttnnccccntttgacnnttgggaacccccnttn

SEQ ID NO: 491 - DNA, 566 bp, Homo sapiens
tcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaac

SEQ ID NO: 492 - DNA, 478 bp, Homo sapiens
gacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatg

SEQ ID NO: 493 - DNA, 400 bp, Homo sapiens
cgttgctgtcggtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaag

SEQ ID NO: 494 - DNA, 399 bp, Homo sapiens
cgttgctgtcgaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcaaaaactcctgggtttcctgttaaaaaatcttaaagcccaaccttatgaatatagtgccccaaaaggcggaagcttcttccattatcttattttctttgaaactttatttaattaaa

SEQ ID NO: 495 - DNA, 550 bp, Homo sapiens
gagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagaccccctcctcccccccagctgctgccttgcacactgaagcatctcagactgtgcaaagccgtgtagtcatcaagacagtaaatcccaaggcttggttaagtgctgtgtgataacttgtttggatgagacttaacttaaaaccacttacaataaacttgggaaactaccgtcaaaaaaaaaaaaaaaaaaaaaa

SEQ ID NO: 496 - DNA, 133 bp, Homo sapiens
tggctctggatagcaccttatggacagttgtgtccccaaggaaggatgagaatagctactgaagtcctaaagagcaagcctaactcaagccattggcacacaggcattagacagaaagctggaagttgaaatg

SEQ ID NO: 497 - DNA, 409 bp, Homo sapiens
  misc_feature 164: n = A,T,C or G
caagtagctttccacatttgtcacagaaatcagaggagagatggtgttgggagccctttggagaacgccagtctcccaggccccctgcatctatcgagtttgcaatgtcacaacctctctgatcttgtgctcggcatgattctttaatagaagttttatttttncgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaaatagtttaggagaaaccagcttttactgtttttgaaaaattacttcacctgtcaagttaacaagtatgcctgtgccaataaaaggttctccact

SEQ ID NO: 498 - DNA, 491 bp, Homo sapiens
  misc_feature 24, 162, 165, 189, 192, 364, 423, 467: n = A,T,C or G
ttttttttttaaagaagtaagccnttatttccttgttttgcaaataaaactggctaagttggttgctttttggtgattagtcaaagagaccaaatcccatatcctcgtccgactcctccgactcttccttggcttcaaccttagctggggctgcagcagcanagnggagcagctgtggtggcagcagcnagngggcagcagccacaaaggcagatggatcagccaagaaggccttgaccttttcagcaagtgggaaggtgtaatccgtctccacagacaaggccaggactcgtttgtacccgttgatgatagaatggggtactgatgcaacagttgggtagccaatctgcagacagacactggncaacattgcggacaccctccagggaaggcgagaattgcagagttttcctctgtggattntcaaggcatttcagggttgttagatgttgccttgttcgaacacntgttgggtgaccagcccaaaggag

SEQ ID NO: 499 - DNA, 352 bp, Homo sapiens
  misc_feature 56, 99, 119, 177, 179, 263, 266, 290, 293, 322, 324: n = A,T,C or G
tttttttttttttttttttttttttttttttttttttttgtgaaaaaccaaacctnaaaaagccactttaattccggcctaacagcgccaggggcaatntctggggacagactctgggnacaatgctgtgtggcgaccactcactcacacacggctccaagaaggcccccaaggggnanttaccttcagggggactgagccaagggggaaaggggtggccccagaacaggggaaggggcaggcatggggggaaaaggtgctanttnttggcaaaggagatcttcatggcnttnttctgcgtaatcttaaagccctgcagggntncgcgagctgcccctgcctgtacctcatt

SEQ ID NO: 500 - DNA, 501 bp, Homo sapiens
  misc_feature 190, 472, 478: n = A,T,C or G
ttttttttttaaacgtgattcttttgttttaaataaatacttagaacacgacttggctcctacaagcatctggactctaggtctcagtactggagtgtctcacccatgggccccacgcagggacgccacggttccctcccaccccgtgatcaagacacggaatcggctgccgatggttggatcgcaatgngccccttttctagagccttccccggccatctacaggcaggatgcggctgggaaaaagacaactggaatttctcgaaggttgatggtccgcacggttgaggattctacgtggttctcttggttcccctgggtgtgtgtgtgtgtgtggaggaggccgcggcctttagatcaccttcttgagctcgtcgtacaggaccagcacgaaggcgccccccatgccccgcaggacgtttgggaccacgcacctttgaagaaggctttgcccccttcatctttgaagatnttcctncaacagtcgaaggttgccctgta

SEQ ID NO: 501 - DNA, 455 bp, Homo sapiens
  misc_feature 376, 390, 426, 433, 451: n = A,T,C or G
ttttttttgataatttatgattttattgtctttcctttgtccggcctttaacatgtttctgtaatttaaataaaaatctatttactttctccattttagcaaatggtttctttacccaaataggttgcactatagtccccatatggttttctactgttccacaaccactatttcacaaagattgacaaaactttaataaaagttaaatttacaggacatcttaaggataacttggggaaatatgtaggtaaaaaaggaatcgagtccacaaattaaggaatattttgctaatatggcccaacaccaatttcaggcaaatccaatctacttaactcatatatttaatgtggggtaatttttcttaaccaaaatttangggggggtatggantggatattatttatggcccttggacaagggtggacngtgtggntttgttgtggactagggngggg

SEQ ID NO: 502 - DNA, 507 bp, Homo sapiens
  misc_feature 358, 476: n = A,T,C or G
tcattttctccccttcggtagagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggntttccacctctttactccttcttcccggacaagcctattcacccagtattccacatggcggttggggaagaacaccctcctcattgctggggttccagggcagggaacaattgcccgngttcatttttcagcgggttccttgatttttt

SEQ ID NO: 503 - DNA, 549 bp, Homo sapiens
ggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatgga

SEQ ID NO: 504 - DNA, 156 bp, Homo sapiens
gccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcg

SEQ ID NO: 505 - DNA, 539 bp, Homo sapiens
cagcaaacatggatcactggcttcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttctttttttttttaaatgaaaagtatagtatgtggcactttttaaagaacaaaggaaatagttttgtatgagtactttaattgtgactcttacgatctttcaggtaaatgatgctcttgcactagtgaaattgtctaaagaaacta

SEQ ID NO: 506 - DNA, 523 bp, Homo sapiens
aagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgc

SEQ ID NO: 507 - DNA, 208 bp, Homo sapiens
ggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttgggggccgct

SEQ ID NO: 508 - DNA, 570 bp, Homo sapiens
gctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacag

SEQ ID NO: 509 - DNA, 580 bp, Homo sapiens
agccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagct

SEQ ID NO: 510 - DNA, 357 bp, Homo sapiens
ggcacgagagtgcgcatcatgcagttctgccatacgctgcgggaatttgcgcttgagtatcggacttgccgggaacgagtgctacagcagcagcagaagcaggccacataccgtgagcgcaacaagacccggggacgcatgatcaccgagacagagaagttctcacgtgtggctggggaagcccccagcaacccctctgtgccagtagcagcgagcatcgggccaggccggggagatgctgacagtcatgctagtatgaagagtatgctgaccagcaggcctgaggacaccacacacaatcgccgtagcagaggcatggtccagagcagctccccaatcatgcccacagtggggccc

SEQ ID NO: 511 - DNA, 78 bp, Homo sapiens
tgcaagatggacacgagccacaagctgcactgcgaacctgggcactccgcgccgatgcacaccggcctgtgggtctat

SEQ ID NO: 512 - DNA, 452 bp, Homo sapiens
  misc_feature 7, 340, 341, 343, 347, 348, 353, 358, 359, 361, 365, 366,378, 388, 392, 400, 408, 409, 412, 428, 444: n = A,T,C or G
ttttaanccccttgtaccggtttggaattcccgggtcgacccacgcgtccgggcttatcttatgatctgggatcagaagtctctgaagaggtgcggtggcttcctgatacgagacgacttcgtgctgacagctgctcactgttggggaaggtgaggagcagaaaacagcccacaccctcctggaaacactccacagagacccctgccttcttccgaaggagctccctgggctcctgtgaacactcatgccaggaggtctccttatagggtgagaaaagggcagttaagtttgtggagagaggggaaggttggttccacaggtgctgctgaattcaaaaannanaggnngaccntcccnncntatnnagaactgggggngtcttttggnatangaatacanactgaacnnttncacctgtgttttctanggggaacctaaccctntaaaacta

SEQ ID NO: 513 - DNA, 324 bp, Homo sapiens
ggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttga

SEQ ID NO: 514 - DNA, 245 bp, Homo sapiens
cgaaaatggtattacaatgctgcaggattcaataaactggggttaatgcgagatgatacaatatacgacgatgaagatgtaaaagaagccataagaagactttctgagaacctttataatgacaggatgtttcgcattaagagggcactggacctgaacttgaagcatcatatcttgcctaaagagcagtggaccaaatatgaagaggaaaatttctaccttgaaccgtatctgaaagaggttat

SEQ ID NO: 515 - DNA, 538 bp, Homo sapiens
ggcacgaggccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccaaaaaaaaaaaaaa

SEQ ID NO: 516 - DNA, 563 bp, Homo sapiens
  misc_feature 522, 546, 553: n = A,T,C or G
tgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttanccagttttatttgcaaaacaaggnaataaangcttacttct

SEQ ID NO: 517 - DNA, 291 bp, Homo sapiens
  misc_feature 57, 103, 233: n = A,T,C or G
agttggagaaaccttttattggcacaggcattccttgttaacttgacagggctgaanctaatttttcaaaaacagtaaaagctggtttctcctaaactatttnccttgtggtagtagagaatcagtgggtcagaaacaactcctgaccacttggtttccttttgagccgcgtcattaggaggcaatctgtaaaactagcacaggtctcccgctgttccactggctcacccacntgattagcagagtgcacgaaaaaataaaacttctattaaagaatcatgctgagcacaa

SEQ ID NO: 518 - DNA, 340 bp, Homo sapiens
acttcaagttggagaaaccttttattggcacaggcattccttgttaacttgacagggtgaagctaatttttcaaaaacagtaaaagctggtttctcctaaactattttccttgtggtagtaaatcagtgggtcagaaacaactcctgaccacttggtttccttttgagacgcgtcattaggaggcaatctgtaaaactagcacaggtctccccgctgttccactggctcaccacatgattagcagaatgcacgaaaaataaacttcctattaaagaatcatgctgacacaatcagaagttgtgacattgcaactccaaatgcagggcctgaactgcgtcc

SEQ ID NO: 519 - DNA, 325 bp, Homo sapiens
  misc_feature 325: n = A,T,C or G
cccagtctggccttgaactcctggagtatccttttgcctcagcctcccgagtagctgggactgcaggtgtataccacctccccaacttggatttactagtagtagcaagtgtagacaagagtctcctatttggaatgtaaattgttggttggaatgtacgttggcacaacttggggaaagtttggcaatgtatatcaaaagcattaaaattgtgtatatcttgtggcctggcaatactccttttatgaatttattataaaaaaaagtacatttatttaaaaacttagctggctgggtgtggtggctcattcctgtaatcccagcn

SEQ ID NO: 520 - DNA, 364 bp, Homo sapiens
cgttgctgtcgggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccg

SEQ ID NO: 521 - DNA, 823 bp, Homo sapiens
  misc_feature 20, 21, 22, 23, 24, 25, 26, 27, 28, 29, 30, 31, 32, 33, 34,35, 36, 37, 38, 39, 40, 41, 42, 43, 44, 45, 46, 47, 48,49, 50, 51, 52, 53, 54, 55, 56, 57, 58, 59, 60, 61, 62,63, 64, 65, 66, 67, 68, 69, 70, 71, 72, 73, 74, 75, 76,77: n = A,T,C or G
  misc_feature 78, 79, 80, 81, 647, 729, 744, 759: n = A,T,C or G
gggcctcagagcatgctcgnnnnnnnnnnnnnnnnnnnnnnnnnnnnnnnnnnnnnnnnnnnnnnnnnnnnnnnnnnnnnnacttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactgtaggatttttaaaaaaaaatccatctcaccccatattggtcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctncccaagtgctgggattataggcatgagccacccgtgcccagcctactttctaattaattaaaaaaaaaaaaaaaaaaacttnccaaatgagctgatnaaaaactgacgtgangctgctttgccttcaataatacctagttttcactggtccaactcgtttccaaatagaaattacg

SEQ ID NO: 522 - DNA, 268 bp, Homo sapiens
ggcacgagggagcaacagggtcagcttctgtatgttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacct

SEQ ID NO: 523 - DNA, 354 bp, Homo sapiens
  misc_feature 279, 290, 299, 311: n = A,T,C or G
ggacattaaaatgcgggggggagggtgtcttagaatataggacatttatctcattttaaccttcacaacgacccagtacaatatatactaactttacttaaatgtttaaactgaggcttagagaggctaaataacgtgtccaaagtcacacagctaatcagtgtgagagctgggattcaaattcatgtctctctgcttctggagcacaaaacactcctcctccccagcacacctgtccacgcagctgcctgggatgcctggtgtctataataccctcancctgggtgcanctacctttntggacctagtcnggagcattggaactccctagggtgaaagagctcgtgcccactc

SEQ ID NO: 524 - DNA, 300 bp, Homo sapiens
aaaggaagaagaagaaggagagcatgaaggaaagatttgtgaactggaaaaaagcaacaaagattgaaaagccatgtactcaagtaccaccaagggatctgccattgggaccctccagggctggatttgatgagttaactgtgaaataccacaagcctgaaaactgaattttgggacttctacccaaatggaaaaataacaactatttttgttgttgttgtttgaaaatgcctctaaaattatatattaattttattctatgcaggggaattaatttagtttttaacaatctaacaataa

SEQ ID NO: 525 - DNA, 408 bp, Homo sapiens
ctgtcgatttaaattatggagcactttatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaagtcttcaaagcatacacaacatgggcctacatatgtacaacaataataatttataagttac

SEQ ID NO: 526 - DNA, 552 bp, Homo sapiens
gcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtg

SEQ ID NO: 527 - DNA, 300 bp, Homo sapiens
  misc_feature 66, 100, 195, 197, 237, 254, 259, 271, 272, 276: n = A,T,C or G
atataattgaaattatgttacatttaagtaatagtaagattatttcattttttttaatttttgtangagatgagggtctcaccatgttgcccaggctggnctcaaatttctggcctcaagtgatcttcccacttcagcctcccaaagcactgggattataggcatcctgccagtaatagtaaaattattaatgancnattttattccattttttaatactaagtcttgcaaatccantgtgttttcacacttantgcanatctcatttcannctanccacagttaaagtgctaaatggcc

SEQ ID NO: 528 - DNA, 418 bp, Homo sapiens
ggcacgagccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccgcctctcaggggggtcccggattgcatccatcacaatcccaaaactagagttggcgggaact

SEQ ID NO: 529 - DNA, 331 bp, Homo sapiens
cactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttacagaaacagcagtgattgatcttctgtggacatgtataatgaacgctgatgagtggaacaagaaggaagaacttgttgcagagcaggctctgaagcacctgaagcaatatgctcccctgctggccgtgttcagctcccaaggccagtcagagctgatcctcctccag

SEQ ID NO: 530 - DNA, 455 bp, Homo sapiens
  misc_feature 81, 195, 231, 247, 298, 307, 317, 395, 427, 446, 451: n = A,T,C or G
ttttttttaaatcaaagagtagtttattaaaaaaggaatcaaacaggaaactctaagtaccagtgtgtacattgtacaatnttaaatgactcacgagaatgaagtttttttcaaatatattaagatcacaccaccttgttgtttatcgaaagatattcaaggagaaagatctgactctccaaactgcatctgagnattgccactttaaacaggacctcatttcaaacatgncaacaacgccactggntaataaaggctttgggaatggggtgctcattctattatttcactacaaacngcatagganaggcaggagnagttggggaatttattctaaaataggaatgggagggttgtccatctacagcaggcactccttcacttcctctgtttgncctttttaggcagtactccttggtcggtcttngaacggttttccaaccctnttcantggg

SEQ ID NO: 531 - DNA, 406 bp, Homo sapiens
caagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttagtagtaaaccagcttttactgttttgaaaattagcttcacctgtcaagttaacaagaatgcctgtgccaataaagttccccact

SEQ ID NO: 532 - DNA, 547 bp, Homo sapiens
ccgttgctgtcggttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactc

SEQ ID NO: 533 - DNA, 255 bp, Homo sapiens
agaattctagctacgatgccatctgatgtcgaattccgcacgaggtctaatcatagatggagagaaagccgaagcctattactgtaatgtgatagaaggatccgtggatattatttggaactgtgccaataagctagttttcagcagaattttgcatttatgtaggattttcccatctcttaacacagtgccttgcacatgactctaaatgaatgcttgttgaattgaattgcagctttaaaaatatctcacata

SEQ ID NO: 534 - DNA, 261 bp, Homo sapiens
ggcacgagatcccctcgaccgctcgcgtagcattaggccgcctccgtaccggtgagttctatccaggagccctgggtactttccagggccagctgacctaacgctggggggccagccgtcccctgcccagctcatccgctggatccagactggggccatctgtggctctcccccgctgtagggatagtcaagagcaactgtgctgtgccactcaagccttgggctaagggatcgcactggggtgtgctctttcggggtgct

SEQ ID NO: 535 - DNA, 400 bp, Homo sapiens
  misc_feature 400: n = A,T,C or G
cgttgctgtcgattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcagaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgn

SEQ ID NO: 536 - DNA, 601 bp, Homo sapiens
ggcacgaggcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgctctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaaca

SEQ ID NO: 537 - DNA, 534 bp, Homo sapiens
tttcgctccatgatgcgttatctgggtctggaaacccaaaccctcaaggatggcctggcgcatgggggaaccagcctgctggggcatggggctacccaggggcttactatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagacaagtgcccccggagcctaccctgccactggcccctatggcgcccctgctgggccactgattgtgccttataacctgcctatgcctgggggagtggtgcctcgcatgctgataacaattctgggcacggtgaagcccaatgcaaacagaattgctttatatttccaaagagggaatgatgttgccttccactttaacccacgcttcaatgagaacaacaggagagtcattgtttgcaatacaaagctggataataactggggaa

SEQ ID NO: 538 - DNA, 472 bp, Homo sapiens
ggcacgagggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaa

SEQ ID NO: 539 - DNA, 505 bp, Homo sapiens
tgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactataaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactacttttaaaaaaaaaaa

SEQ ID NO: 540 - DNA, 211 bp, Homo sapiens
aatgtgcctcagcctgtagtgctgtgtggcaacagcattctggttcccactgacaagatctcccaccactctggtgggatctgcagaggcagggagtgggggttgtgtctaggggaagtcatcttttgagatccagatagacatggtttgtgcacttacgtccagatgggaagcatccttgctgcaaccctaaaataatcatgcaccctgt

SEQ ID NO: 541 - DNA, 415 bp, Homo sapiens
cagcgtccaagcttcctgaaaagcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgc

SEQ ID NO: 542 - DNA, 504 bp, Homo sapiens
ttgaagagcagctcaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagt

SEQ ID NO: 543 - DNA, 491 bp, Homo sapiens
atgaactcggtttaagacagggcttcttcaccattgcgagaacgttcaccgggacgagtggcaagagtcttggcttggatagcatgaagagccccagtacaaggaagaatactggaaatgctcaattcgtggagcgcgtttaaacgacgatttatttggttttcaatgaccgaggacttatgacaggatgattacatttgaccttgggacatgaacgcttggactgctgacttgtgtgtaaagctgtttgtttgtttgtgtcttgcttgacagtggttctcgatcatgatgatacctgatgctttggacatgtccacttactcctctattattcgttggatcattgtttattctgatagatagtgacttatgttcggatgtcgatcacaggattgtgattgttagtccactgtatctctgatcgaataggtctatatattattatttagatagaaaaagtagcaatccacttaggagatttattgatctgc

SEQ ID NO: 544 - DNA, 285 bp, Homo sapiens
caagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctg

SEQ ID NO: 545 - DNA, 471 bp, Homo sapiens
  misc_feature 11, 12, 375, 414, 421: n = A,T,C or G
tttgtactttnnaaggatcccagcgattcgcaggagggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaangagggcaaccctgaggaagactcacagctgacaaggcanatgccangccgcagctctgtataagtctctgatgcaactgacagatgaacttgacaa

SEQ ID NO: 546 - DNA, 249 bp, Homo sapiens
  misc_feature 42, 202: n = A,T,C or G
ggcgtgcaaacagagcgccactgggaggctgaaacctttagnccgatgcctgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacntctactgggcgagaccaggagtgatggctcagcctgtaattctggaa

SEQ ID NO: 547 - DNA, 259 bp, Homo sapiens
cctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcatgtgattgatg

SEQ ID NO: 548 - DNA, 271 bp, Homo sapiens
  misc_feature 48: n = A,T,C or G
tttgtatttggtgaaatggttttaattatactccatgtgtattttgcncactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggt

SEQ ID NO: 549 - DNA, 313 bp, Homo sapiens
tttgcctcatggctcggttctatacttacatcaacccagcggagatcgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattggatggcccctgatgaggaagacttcagaattgggaactaaaccatgaatgctattttcttttttctttttcttttctttttttttttttttttt

SEQ ID NO: 550 - DNA, 575 bp, Homo sapiens
acgtacgttcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacattacatttttgggggggaaagtgcttatgaatggtgcaggttgactctgatattcattcccaaatgacagtatggcagagtgttccagaaatgagagtggcatctttatggaatcactatggatactgactgtctcagtaaacagctgtcttgtctgtgtgtatattgtttgatcagggtacatggcagccagtcacagattggaattacatatga

SEQ ID NO: 551 - DNA, 664 bp, Homo sapiens
ttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcaaagccctgccctgcacccttgtacagtgtctgtgccatggatttcgtttttcttggggtactcttgatgtga

SEQ ID NO: 552 - DNA, 536 bp, Homo sapiens
aaattaacaacatgaagaccaagtttaaagaaacaattgagaagtgtgataatctagagcacaaactaaatgatcttctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttc

SEQ ID NO: 553 - DNA, 553 bp, Homo sapiens
tcggctcgaggtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgct

SEQ ID NO: 554 - DNA, 601 bp, Homo sapiens
cactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccata

SEQ ID NO: 555 - DNA, 110 bp, Homo sapiens
cggctcgagtcaagagaaaacacaagaaggacatcagccagaacaagcgagccgtgaggtctgcgcaccgcctgcgagagggccaagaggaccctgtcgtccagcaccca

SEQ ID NO: 556 - DNA, 470 bp, Homo sapiens
ctgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaaggcccgggctgggggcccacccctttaattttaaccttttgggggggttggggggggggattaaaagggccaaaatttaaaaaccccccggccaaactgggaaaacccccttttttataaaaaaaaaaaaa

SEQ ID NO: 557 - DNA, 290 bp, Homo sapiens
gtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcatttaattccaattta

SEQ ID NO: 558 - DNA, 481 bp, Homo sapiens
aacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgcc

SEQ ID NO: 559 - DNA, 205 bp, Homo sapiens
gtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgca

SEQ ID NO: 560 - DNA, 645 bp, Homo sapiens
ggaattcggctcgagcgcgtctccgcgcccgcggacttctgcctgcctccttctctgaacgctcacttccgaggagacgccgacgatgaagacaccgtggaaggttctcctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatg

SEQ ID NO: 561 - DNA, 271 bp, Homo sapiens
gagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatc

SEQ ID NO: 562 - DNA, 277 bp, Homo sapiens
  misc_feature 43: n = A,T,C or G
tcttaggagtttcttgtttgccctcttgtgtaattacggtctngtttttttcagtaatgtcctgtttgcccttcttatcagcatctatctagctacattctgacaggataactgcaaactgaatgattcctgggcatcataatggatgtttctttctacttaggtgtctcccctcctctctgcttatatctagcatgcctgttttgggtggtccctggggttgtgggatttcccaggggctacccttcctgctcttggctagatatctgcctctcta

SEQ ID NO: 563 - DNA, 239 bp, Homo sapiens
gcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactgg

SEQ ID NO: 564 - DNA, 119 bp, Homo sapiens
  misc_feature 84, 88: n = A,T,C or G
acggaagatgactttgtatcactgcaagcgcttcaacaccttcatccatgaagatatctggaacattcgtagtatctgcagcancaanaatatccaatgcaagaacgggaagatgaact

SEQ ID NO: 565 - DNA, 275 bp, Homo sapiens
gtgctgcatcaggatttgatttgtatgccatctgttgcaatgcacttggttttacttgcttgtcaatgagaaatactgcttccaaatgtcttcatggttttgtccatactggactttgggttatgatttttcaccttctactcccctgaaatcattatcctaaagtaactttttttaggcacctattttctggggatcaacatgtaaaaaaacatttatattgtcttgaggagttgtcaacaacaataaattgaaataaaaaagaaatgtatgaa

SEQ ID NO: 566 - DNA, 286 bp, Homo sapiens
  misc_feature 64, 65, 66, 67, 68, 69, 70, 71, 72, 73, 74, 75, 76, 77, 78,79, 80, 81, 82, 83, 84, 85, 86: n = A,T,C or G
atttgctcattgctgtaccacatctgctctagggaatctggattatgttatacaaggcaagcannnnnnnnnnnnnnnnnnnnnnnggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaatcac

SEQ ID NO: 567 - DNA, 596 bp, Homo sapiens
tcggctcgagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgaccctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctgtaatatggaacaaatatctgaatgaaatccaccctaggagacggagtcaaactaaacttgtggtttttcatttaacttttgactacagcatggccccatggcatccacaccaagaaggtgttgtgatgaggtgccggtgtgcaaa

SEQ ID NO: 568 - DNA, 494 bp, Homo sapiens
gctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtggtgtttttccgtaataagcaaaataaatttaaaaaaatgaaaagttgaaaaaaaaaaaaaaggg

SEQ ID NO: 569 - DNA, 599 bp, Homo sapiens
taagctcggaattcggctcgagcacaaagttctgttcttcttcctggcagcttcggacgaaattacacaggcatctcccatgcccaccacccgttaggaatgtccattcctgggctgcgtgcgcaggtccagcagccagtctgtgcaggcgcctggcccggccagggagattgaggcagacccccacaagccctgaaccccagtctcaagttttctgcacgacctgtacttcagtcaccagacactcctccaggccggctttgcccgcctcccagaccacctgcagagacgagaggaggcagggtgagtcggccaccccccagataacagagcccacgtcctgatctgcgggggcctgtcccatctcagatctgctctgtgggccaggcatggtggctcacgcctgtcatcccggcactttggaccaggcgcggtgggtcacacctgtaatcccagcactttgggaggccgaggcgagcggaccataaggtcaggagatccaggccatcctggccaacatggtgaaaccccttctctactgggaatgcaaaattagctgggtgtgttggtgcatgcctgtggtcccagctgcttgggag

SEQ ID NO: 570 - DNA, 509 bp, Homo sapiens
aaaacgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatgggtcacgtttggtgcttctcagatttctgaggaaattgctttgtattgtatattacaatgatcaccgactgaaaatattgttttaca

SEQ ID NO: 571 - DNA, 99 bp, Homo sapiens
  misc_feature 37: n = A,T,C or G
ctctaaacttttaaataatcgtgaaatgtatgcgcantgaagcgaattcagctatttcctctaccttttgtgtggaatttaaaatactgaacttgtgag

SEQ ID NO: 572 - DNA, 622 bp, Homo sapiens
gtaagctcggggcaatcaagctggctaggttcctgccacaagttcagactagtcttctgtaggtgagaaagcgcataatgatattaatatccacctcccaaaccccagagtgtgttacattccagggtgataaacctagaggggccttcttcctcttcccagaggaaattcacttacatttcaagataatgaataatttctctcctgaatgggaggaatgggtaggtcaccagcagctttgataaaagcttggaggcttctaaatttaagattcttctcctgtgatgcaacccactgcacaggaaacatctgttgccttacgggaaatggggcatggggaaatgacacaaggtgttgtaaatgctttgtgctttcagtagcaaatcttttatggcaccagcccagcagtctggtgtcttctggcagtatatgtatatgaaactgtggcgggctagcctgttggcttgcaagagggacaaactctaagacacttcacagtttctgacttaacaggggagagtggcaggatgtgaaggtgaaggagcaggcagggcaaattacatagcaccatccatagctaaggtaatagatgaattgttaatgttaaaaataatgacagctg

SEQ ID NO: 573 - DNA, 299 bp, Homo sapiens
  misc_feature 266: n = A,T,C or G
gagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggaaacacagtctcccacgatgtcacccctcgcctcccctccttcttccccgcctcattaccagagggtgcccttgagccatggctacagcaaactgcgganagcggcagaacagatgcatccagcaccttatga

SEQ ID NO: 574 - DNA, 579 bp, Homo sapiens
aactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggcgcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatcta

SEQ ID NO: 575 - DNA, 541 bp, Homo sapiens
taagctcggaattcggctcgaggtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcggtaactctgctctttttgacccctctagcatagctcaggaccacccctccaagccctgagtctcttctctgctggtctgacagaaccgcgttgctagaagctcgcgactcagggctgtgcttagtccatagtgatcatggcgccttgccctt

SEQ ID NO: 576 - DNA, 561 bp, Homo sapiens
ctaactcgtcttccggtgggaatttcttcacgtgggccggagtcggagactgagtttaactttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccggga

SEQ ID NO: 577 - DNA, 346 bp, Homo sapiens
gttcctctagtgtgtggatttgattttgtgtctttgtgcttcctgttgcctcctggtgaacgcagttctgacctttcctttgtttgcaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 578 - DNA, 248 bp, Homo sapiens
ccacagcccacagccatgggctgggacctgacggtgaagatgctggcgggcaacgaattccaggtgtccctgaacagctccatgtcggtgtcagagctgaaggcgcagatcacccagaagatcggcgtgcaccccttccagcagcgtctggctgtccacccgaacggagtggcgctgcaggacagggtcccccttgccagccagggcctgggccccggcagaacggtcctgctggtggtggacaaatg

SEQ ID NO: 579 - DNA, 490 bp, Homo sapiens
aattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggat

SEQ ID NO: 580 - DNA, 254 bp, Homo sapiens
cccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaa

SEQ ID NO: 581 - DNA, 269 bp, Homo sapiens
ctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgcggggcccgacactgtggtcattggcatgactcgcatccctgtcattgagaacccccagtacttccgtcagggacacaactgccacaagccggacacg

SEQ ID NO: 582 - DNA, 382 bp, Homo sapiens
agtgagtcatccgtccagaagcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaac

SEQ ID NO: 583 - DNA, 593 bp, Homo sapiens
tgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaag

SEQ ID NO: 584 - DNA, 245 bp, Homo sapiens
gcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctg

SEQ ID NO: 585 - DNA, 575 bp, Homo sapiens
cctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggc

SEQ ID NO: 586 - DNA, 590 bp, Homo sapiens
tcattgattttatttgctgttccaaaatccaggaaatgttggagtttcttttatcaggcctcaaagcagaagaataattctccgtggttcttggctctaccctctagactcttggttttgtcttctgagtcttcctttttcatcaaagctagagtgtgtttttacctgagttcttttctcaggctgcttctttccagtagaattttaggggaactagtggtctctattttgtactgtttctgtcctttttgatccaagatggcagtgtttctactgatacagaagattttgtgggcctcctgtgattctccttgggatttactccattagacaaaagccacactcataaatatcttctttatgagacctaagcttcttacagactctgtttttcggttgaaaggatctgtgaaacataatcttctgaacagccttttgtatgactgaatagcacaatcagccctccgtatccacaggttccacatcccagattcaaccaactgtggactaaaaatacaaaaattagctgggtgtggtggtgcgtgcctgtaatcccagctactcaggatgctgaggcaggagaatcactt

SEQ ID NO: 587 - DNA, 150 bp, Homo sapiens
  misc_feature 32, 118, 132: n = A,T,C or G
gttaaaaaggcgggcggaaccaaacctaagangccagttggggcagccaagaagcccaagaaggcggctggcggcgcaactccgaagaagagcgctaagaaaacaccgaagaaagcgnagaagccggccgcngccactgtaaccaagaaa

SEQ ID NO: 588 - DNA, 160 bp, Homo sapiens; identical to SEQ ID NO: 12

SEQ ID NO: 589 - DNA, 223 bp, Homo sapiens
  misc_feature 204: n = A,T,C or G
ggggcagcaatgggaccatctgtgacaaccagagggactgccagccggggctgtatgtgccttccagaggagggcctggctgtttccctgtgtgcacacccctggcccgtggagggcgagctttgccatgaccccgccagccggcttctggacctcatcacctgggagctagagcctgatggagccttggaccgatgccctgtnccagtggcctcctctgcca

SEQ ID NO: 590 - DNA, 587 bp, Homo sapiens
tgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatac

SEQ ID NO: 591 - DNA, 424 bp, Homo sapiens
gatacccccctctgtcttgtgaaggcagggggaaggtggggtcctggagcaaaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggg

SEQ ID NO: 592 - DNA, 446 bp, Homo sapiens
tggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttgg

SEQ ID NO: 593 - DNA, 194 bp, Homo sapiens
catcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtc

SEQ ID NO: 594 - DNA, 341 bp, Homo sapiens
atggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctat

SEQ ID NO: 595 - DNA, 240 bp, Homo sapiens
caaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacaaagaggttgaggaagaaagaattg

SEQ ID NO: 596 - DNA, 179 bp, Homo sapiens
  misc_feature 17, 19, 30, 33, 38, 49, 55, 79, 101, 110, 138, 145, 162: n = A,T,C or G
accacccaaccgtaacnanccctctcacantgnaatgnagtgcacggtntgaatntgcacacaccaacatgctgagtgnagtcgggggtttgtgctgggcntgctcttcnttggggccgggctgttcatctacttcangaatcanaaacgacatctggactnaaccaacaagattcctt

SEQ ID NO: 597 - DNA, 320 bp, Homo sapiens
tttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgggcaccatgg

SEQ ID NO: 598 - DNA, 533 bp, Homo sapiens
gaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggct

SEQ ID NO: 599 - DNA, 442 bp, Homo sapiens
acaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctgaaaaaaaaaaa

SEQ ID NO: 600 - DNA, 660 bp, Homo sapiens
ccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgcttt

SEQ ID NO: 601 - DNA, 494 bp, Homo sapiens
atgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcaaaacattttgtggaattcgtgaaacttgtccgtgccaaatttcctgaacacaccattatggcagggaacgtggtgacaggagaaatggt

SEQ ID NO: 602 - DNA, 500 bp, Homo sapiens
acctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgac

SEQ ID NO: 603 - DNA, 567 bp, Homo sapiens
ccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagaaatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgc

SEQ ID NO: 604 - DNA, 569 bp, Homo sapiens
gaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcaaggctggaagtcccgtcagttctgctgaatactatgtccaagtgtgtgatggcggctgcaatctgtctt

SEQ ID NO: 605 - DNA, 650 bp, Homo sapiens
accctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaagataagtgtgagccactggagaagcagcacgagaaggagaggaaacaggaggagggggaat

SEQ ID NO: 606 - DNA, 271 bp, Homo sapiens
  misc_feature 224, 229: n = A,T,C or G
cggttggctcggcgcgggagtcggctgcacgtgcgggcgggggcgatgcgtcactgattcggtgaggcgcggccgaggggtcggctttcctcgcgagcctgcggctgggcttcttctcagaggaacgagaatgaatatgactcaagcccgggttctggtggctgcagtggtggggttggtggctgtcctgctctacgcctccatccacaagattgaggagggcnatctngctgtgtactacaggggatgagctttactaactagccccagt

SEQ ID NO: 607 - DNA, 282 bp, Homo sapiens
  misc_feature 14, 31, 58, 60, 66, 89, 125, 197, 211: n = A,T,C or G
gtaaaatgttaaantttcagctgtatttttnttttcttttccgatgtggctactaganantttaanatgacacatggctcacattttanttcttttagccagtgctgctctagactgagtttgcntgaggtgtaactgtctagagctatagtgacatgtaagtaatatacatgctttgtacaaaatctccctataanctgctgattttganattgaagtcatgaaagacagattgaaccgatagagtcctttgagagtcaccagttactggtccactctctg

SEQ ID NO: 608 - DNA, 312 bp, Homo sapiens
ccctggaggtctatcctgcatacctggagagcttctctggtcctgcccaccttgaaagttgcagactttgttgtaacatctatgtgatgagcttccctgtgaagccccatttgacaggtgggccagcagtgttttatcagcactctgatggcccacatttcccaggaaaacttcttgaaacttaccgttgtgggcagtggtcagagcgtgtagttcttatgactgtcttgtttcatctgtggagcacgtgtggagcagttggtacagcagtttctgtggggtttggcatgggtgattttggttagtaaccat

SEQ ID NO: 609 - DNA, 242 bp, Homo sapiens
cttgggttcccttattctcccagtctgtgatgaattgctttgacttctgacacctcgtatgaaaactgcacgtgcagtctgattatttagcaagactgaggcttgagggtgcgcactcctgacggggagctgagagtggaaacaggtgttgcccgaaacgaaggagtggggacttaatgtctgtattttggcgctgactttcaggtttcgtcgcgagccggctgcaagttttgaacctaagt

SEQ ID NO: 610 - DNA, 78 bp, Homo sapiens
gaactttgccgttgaagctgctaactaccaagacactattggccgcctgcaggatgagattcagaatatgaaggagga

SEQ ID NO: 611 - DNA, 525 bp, Homo sapiens
gccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctactgtgagtccagctgaggcccacccaggtggtccct

SEQ ID NO: 612 - DNA, 77 bp, Homo sapiens
  misc_feature 17: n = A,T,C or G
cccagacagactcgganagatggcaggcggaagacaccggcgcgtcgtgggcaccctccacctgctgctgctggtgg

SEQ ID NO: 613 - DNA, 476 bp, Homo sapiens
acgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatc

SEQ ID NO: 614 - DNA, 160 bp, Homo sapiens
agagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgtta

SEQ ID NO: 615 - DNA, 272 bp, Homo sapiens
cagttatctaagctttgattccttacagcaggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgtgtttttttgattgatgttcaatatacccag

SEQ ID NO: 616 - DNA, 341 bp, Homo sapiens
  misc_feature 74, 81, 86, 93, 96, 100, 105, 108, 111, 117, 129, 137, 197,208, 210, 231, 257, 259, 261, 263, 268, 275, 290, 292, 294,316, 320: n = A,T,C or G
gctgtactggagccacccgcgaaaattcggccagggttctcgctcttgtcgtgtctgttcaaaccggcacggtnctggatnccggnaaatatnggncctncaatnatngtngcccgnccaagttgtttntcccggtncaagttaaccggcggaaaagggaattaattccgggttttttccattttaaaaggtttggngaaacttaaanantgggcttccttttcccttttncaaggaaggggaatttaattccccgngngngncaatncttaacnttccaaattggaaanananaacccaattggaattaaatttncctntttggttaattaattaaaaca

SEQ ID NO: 617 - DNA, 556 bp, Homo sapiens
taagctcgggattcggctcgagggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttaagggtgcgtggtccaacgtcctgcggggcatggggggcgccttcgtgctggtcctgtacgacgagctcaag

SEQ ID NO: 618 - DNA, 553 bp, Homo sapiens
cctcctgctgctctcggcggccctggccctgaccgagacctgggccgtgggctacgtggacgacacccatttcgtgaggttcgacagcgacgccgcgagtccgagagaggagccgcgggcgccgtggatagagcaggaggggccggagtattgggaccggaacacacagatctacaaggcccaggcacagactgaccgatagagcctgcggaacctgcgcgggtactacaaccagagcgaggccgggtctcacaccctccatagcatgtacgggtgcgacgtggggccggacgggcgcctcctccgcgggcatgaccagttcgcctacgacggcatggattacatcgccctgaacgaggacctgcgctcctggaccgccgcggacacggcggctcatatcacccatgcgcaagtgggaggcggcccgtgaggcggagcatcggagagcctacctggagggcgagtgcgtggagtggctccgcagatacctggagaacgggaaggacaagctggagcgcgctgaccccccaaagacacacgtgacccaccaccc

SEQ ID NO: 619 - DNA, 579 bp, Homo sapiens
caaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtacca

SEQ ID NO: 620 - DNA, 367 bp, Homo sapiens
ccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctg

SEQ ID NO: 621 - DNA, 383 bp, Homo sapiens
ggttaggcatctatccaatctcccatgccagtaattctacagaaacagattaggttagctagataagcatgtttacaattaaatttatgctgtatccttctaatcaccactttctcatcaaaatgctcacaaatcatctgcatcattgtccattctttaaaaatgtataaacccatctctactaaaaatacaaaattagctgggcatgatggcgcacgcctgtaatcccagctgttcaggaggctgaagcagaagaattgcttgaaccccggagacggaggttgcagtcagccgagattgcaccattgctctctagcctgggcaacaagagcaaaactccatctcaaaaaaaaaaaaaaaaaaaaagggtaaattttttttaa

SEQ ID NO: 622 - DNA, 470 bp, Homo sapiens
gcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgct

SEQ ID NO: 623 - DNA, 468 bp, Homo sapiens
attccgcgacttctcgaagtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatc

SEQ ID NO: 624 - DNA, 521 bp, Homo sapiens
aagctcgggaattcggctcgaggtggactggctgacaaagggacccagcttcccatcactaccccaggtctccaccagccttctggagaacctgaagaccagctgcccacagagccaccttcaggaccctcggggctgcccctgctgcctgtgctgttcgctcttggggggcttctgctcctctccaatgcctcctgtgtcgggggggtcctctggcagcggagactcaggcgtcttgctgagggcatctcagagaagacagaggcagggtcggaagaggaccgagtcaggaacgaatatgaggagagccagtggacaggagagcgggacactcagagctccacggtcagcacaacagaggcagagccgtattaccgctccctgagggacttcagcccccagctgcccccgacgcaggaggaggtgtcttattcccgaggtttcacaggtgaagatgaggatatggccttccctgggcacttgtatgatgaggtagaaagaacgtaccccccgtctggagc

SEQ ID NO: 625 - DNA, 547 bp, Homo sapiens
ggctcgagcccagagtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgacc

SEQ ID NO: 626 - DNA, 230 bp, Homo sapiens
  misc_feature 22, 38, 52, 58, 77, 132, 157, 177, 191, 195: n = A,T,C or G
actcattccaatcaggccctanaccagttgtttgacanaatcatggcattanacattnatgagcgccacctactgcntcttggtcatggagaagaagagctggagacagagaaagatttcagcaggtatggnagagttaattatgttctggctcgangaatagaacttttagaagangtcaaacgattgcnaaanagtctaggggttccaggagatgcctcatatacctg

SEQ ID NO: 627 - DNA, 543 bp, Homo sapiens
aagctcggaattcggctcgaggattgattcttcaatgggttcagcatttcacttccctctgaaattaagtggcaaagtaatagcatcccttaaaaaacaggacattggtgagaggtacaatagcaggaggaattttgaaacatggagggatggctactggaaaagaactgatgaagtgcagagtctctccagacaatggtagaaaccacaggactacattaagattgggcccaaatactagtttaaaaaaaggtaaataaaactagctttacttaagagtacagccagcttaattactggctagtggacatatttcagacaaatctaactggagagaaaaacagaccaggagagaaagcgaagttacaatgaaatggaactagagaaacctcacaaagggataaaggaggtaattaaaggttaaagccagatagcctcgagctcaaaggagaaatattggaggccagataggaaagtgccttcctactcagggggttatggatccagggtggctaaataatagaagtagagttccacccaggg

SEQ ID NO: 628 - DNA, 580 bp, Homo sapiens
gaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactccc

SEQ ID NO: 629 - DNA, 584 bp, Homo sapiens
tcggctcgagaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttga

SEQ ID NO: 630 - DNA, 97 bp, Homo sapiens
ggggaaaggaggtctcactgagcaccgtcccagcatccggacaccacagcgggcccttcgctccacgcagaaaaaccacactttctcaaacctttca

SEQ ID NO: 631 - DNA, 497 bp, Homo sapiens
gagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagaaaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtag

SEQ ID NO: 632 - DNA, 281 bp, Homo sapiens
aagaccccgaacacctccaacatgaagcttcttcatgttttcctgttattctgtgcttccattaaggttttgcaaggtcacttatacatctccaagaggatctggtggagaaaaagtgcttagcaaaaaaatatatcacctctcctgggataaagtcttctgccagccatggcagagatgcattgagggcacctgtgtttgtaaactaccgtatcagtgcccaaagatggcactgcagtgtgtgcaactaacaggggaagttcccaacatactgtcacaaa

SEQ ID NO: 633 - DNA, 477 bp, Homo sapiens
aagcatatatactgtagggagaagtatcaaaatcatttaaggtcttttttccaaactagtgttcccctcccacatcccaataactcttggaagtctggtgctccctctaggtgaaaatcatttgctggcttatggagtcactgttgctgagtcccatcccccagttacagtgcagtggaaaacaggtttagaatctagaacttgtttgtatgttgtcacttggttatgttccaagtaggttagaaccatggaaaagagattgcaaatggtagtttcttctagatattcaaatgcatatatgtatgtacatgtaattataaataaataatgaatttttattaaagtgttgtatgaacataggtttttgtttgtttctgaggcaggagaatggcgtgaacccgggaggcggagcttccagtgagccgagatcgcaccactgcactccagcctgggtgacagagcgagactccctctcaa

SEQ ID NO: 634 - DNA, 562 bp, Homo sapiens
ggtatttaggttcccatatatgaattgtggggggatattaacatttagaccatagcacctactcatgaaagaacattaataattaacacctctagtgagtatttgtgagtctaggatttacagaacataaggatattgtacaaattttaaaagccaaaatgagttttagtattactaaacaacaactgttcagcaggaaaaaaaagaaaatagtaatacagaatccctgtaagcattacctgcactaaactgagcacacaattataactcaagctttacataaaaaaaatgctggtgacaaaggtaaaaattttttatctggcctctattttaagccgttattaaaaaataaacaggctgggcatgtgtcttacgcctgtaatcccaacactttgggaggccaaggcaggcggatcacctgagatcaggagttcaagaccagcctggccaacatggtgaaaccccatcaccactaaaaatacaaaaataagccaggcgtgatggcgcatgcttgtaatcccagctactcagaaggctgaggccggataattgcttgaatccg

SEQ ID NO: 635 - DNA, 234 bp, Homo sapiens
gttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcaatcaggctctttaagggtcacccagagactctggagaagtttgacaagttcaagcacctgaagtcagaggacgagatgaaag

SEQ ID NO: 636 - DNA, 106 bp, Homo sapiens
  misc_feature 43: n = A,T,C or G
cttgaagacgttcagcctcatgacttaggaaaagttggagacngtcattgtgaccaaagacgatgccatggctcttaaaaggaaaaggtgacaaggctcaaattga

SEQ ID NO: 637 - DNA, 278 bp, Homo sapiens
  misc_feature 189, 223, 229, 250, 263: n = A,T,C or G
ttctgtcatcaaacaaaaacaggtatcagtgcattattaaatgaatatttaaattagacttaccagtaatttcatgtctacttttaaaatcagcaatgaaacaataatttgaaatttctaaattcatagggtagaatcacctgtaaaagctgtttgatttcttaaagttattaaactgtacatataccnaaaagaagctgtctggattaaatctgtaaaatcngtaganatttactacattgctgttaanatatttataagtntgtccttttcaccag

SEQ ID NO: 638 - DNA, 218 bp, Homo sapiens
gcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaagg

SEQ ID NO: 639 - DNA, 272 bp, Homo sapiens
cgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggc

SEQ ID NO: 640 - DNA, 235 bp, Homo sapiens
cttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcat

SEQ ID NO: 641 - DNA, 295 bp, Homo sapiens
atcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatgggg

SEQ ID NO: 642 - DNA, 499 bp, Homo sapiens
cctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcaaaaaaaaaaaaaaaaaaaaaaaggggggcccccc

SEQ ID NO: 643 - DNA, 449 bp, Homo sapiens
ttatatgtaattgcctgctgtcagtgaatcttgggtttaaggcccattagaaaatagcaggctttagtagagtggttttttccagtgagtacttttcagtcaacaggtttattgggaggtggctaaaatgcacatggaggtgagcccttccctgccagacaagcaaagaatcaagctgtatatttaaaacttggctgttaacccaaaggatttctacaggaagtttttttctcctttgatgtttgtagaggggtttttttttcccctcccgacaaaatcaatacacagaaaacccaaagctcttaatttgcaaaactgaatggatttgtgaaaataaatacctttttggcaaaaatgcaatttggcattaatcccttgatctaaaacttaaaaaaaaccaggctgaattcaaatttattgatggatcaatttaaagagttttaatctgg

SEQ ID NO: 644 - DNA, 583 bp, Homo sapiens
aggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtc

SEQ ID NO: 645 - DNA, 507 bp, Homo sapiens
cctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgc

SEQ ID NO: 646 - DNA, 620 bp, Homo sapiens
tgcaatagagtgtcagccaaatgtgtcatacatcaaatcttcagcagcttttgcataatccaggagaattgaataatagttgaagttaattttgccagtgaaatgtacggaaagaaaaatgtttgaaatttaaattattcagatagctaaattcttaatcctaaaatttaaaccccttaattctgtctgtagtgttatatcaagactttttgatagtcatgaaactgagtaaaactttattcagattacttaaaaacagcttttcctgtggttaataacacctttattttgaacagagtactcttaagcaacttatattgtgctgattaaagatttaatctgtgcatattttttaccctgttgtttatttagttttgataactgtgaaataaaccataattaaatcacaaaagtcacctgcctcttttgtttccctggaaatttggccaaattttttttaacggaaagttctgctaatgaaaattgggaaattggagacatatattattttgactgtgtgtcctctgtcattaaagatggactatactagctgggtgtggttgctgatgcctataatcccaccactttgggaggccaaggcaggtagacggcttgagctc

SEQ ID NO: 647 - DNA, 377 bp, Homo sapiens
tgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatggaggttttgctccctttcctt

SEQ ID NO: 648 - DNA, 298 bp, Homo sapiens
  misc_feature 50: n = A,T,C or G
cttgcgcttgtttagccctgaaccaggagcaacagggtcagcttctggangttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaa

SEQ ID NO: 649 - DNA, 455 bp, Homo sapiens
tgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcacc

SEQ ID NO: 650 - DNA, 429 bp, Homo sapiens
gatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcacttttttttttttttttttttttttt

SEQ ID NO: 651 - DNA, 265 bp, Homo sapiens
  misc_feature 46, 50, 62, 74, 91, 108: n = A,T,C or G
gtaatgatagcaaagccatcgtgaagacccttgctgctaccggganaggntttgactgtgcnagcaagactganatacagttggtgcagantctgggggtgcctccanagaggattatctatgcaaatccttgtaaacaagtatctcaaattaagtatgctgctaataatggagtccagatgatgacttttgatagtgaagttgagttggtgaaagttgccagagcacatcccaaagcaaagttggttttgcggattgccactga

SEQ ID NO: 652 - DNA, 543 bp, Homo sapiens
  misc_feature 43: n = A,T,C or G
ctgatcagtgttctagaacagatcagacattttgtaatgatgncctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaaagaagttcctccagaagaaattaattatttaacacgaattcactacaaagctcagtctgatggtatctgggggtgaacatgaaattgattacattttgttggatggtgagcagcgtccctctcatgtgacacccacagtt

SEQ ID NO: 653 - DNA, 475 bp, Homo sapiens
gttcaatatgtcaagggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcat

SEQ ID NO: 654 - DNA, 224 bp, Homo sapiens
gccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatg

SEQ ID NO: 655 - DNA, 269 bp, Homo sapiens
cccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaat

SEQ ID NO: 656 - DNA, 329 bp, Homo sapiens
ctttattagttgggcattctttatgaccttttctataaaacagtaaggacattaaaatgtaagatgcatgacaaaaatataagtggagaggctcattgtagttaacctatattaagtaatgtttaaggtaggtgttcagagtaatacttttctacattatactgagagaaagaaattataaattaaagtatatcaattattttactaattttactgttacgtaataaaatgcaatatatttaaaaattgttagattatgtgtgaacttaacttatattttatttacttacttaacttttcttttgggatggagtcttgctctgtcgccc

SEQ ID NO: 657 - DNA, 259 bp, Homo sapiens
tcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacct

SEQ ID NO: 658 - DNA, 592 bp, Homo sapiens
agccgctgcctctgttctcagcgtcagtgccgccactgcccccgccagagcccaccggccagcatgtcctctgctcacttcaaccgaggccctgcctacgggctgtcagccgaggttaagaacaagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcaaagaagcaggagcggaaattcgagccggggaagctaagagaagggcggaacatcattgggctgcagatgggcaccaacaagtttgccagccagc

SEQ ID NO: 659 - DNA, 463 bp, Homo sapiens
cgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatc

SEQ ID NO: 660 - DNA, 255 bp, Homo sapiens
ggacgacctcatctttaccagcaagaagtcactctttgggaagatcaaatcatttacctccaagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatca

SEQ ID NO: 661 - DNA, 513 bp, Homo sapiens
gccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatcta

SEQ ID NO: 662 - DNA, 399 bp, Homo sapiens
ggtgcgccagagcccgggaaaggcctggagtggatggggatcatctatcctggtgactctgatatcaaatacagcccgtccttccaaggccaggtcaccatctcagccgacaagtccatcagcaccgcctacctgcagtggagcagcctgaaggcctcggacaccgccatgtattactgtgcgagacagtctgtcagctcctggtaccttgactactggggccagggaagcctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgcc

SEQ ID NO: 663 - DNA, 479 bp, Homo sapiens
  misc_feature 290, 293: n = A,T,C or G
agcacagtaaatgttagcatatttatttaaatagtcctgcagcagagaccctgcgattgtaaagtgatttaagtatttctgggtagtgtttgtgatttacggatttgttactgaaaaacaaaaaaaatcactactgtgaatttactactatgtaaccttgtggtcgtatttcattataaataaaataagaattgctcttctgccaaaaaaaaaaaccccaaaaaaaaaaaaaaaaaaaaaaaaaataaaggggggggggcccccaatttttatattttttcaaccaccanaancttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaac

SEQ ID NO: 664 - DNA, 250 bp, Homo sapiens
  misc_feature 117: n = A,T,C or G
gccgctgcgatgaccaaaataaaggcagatcccgacgggcccgaggctcaggcggaggcgtgttccggggagcgcacctaccaggagctgctggtcaaccagaaccccatcgcgcanccctggcttctcgccgcctcacgcggaagctctacaaatgcatcaagaaagcggtgaagcagaagcagattcggcgcggggtgaaagaggttcagaaatttgtcaacaaaggagaaaaagggatcatggtttt

SEQ ID NO: 665 - DNA, 538 bp, Homo sapiens
tcggctcgaggcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatc

SEQ ID NO: 666 - DNA, 582 bp, Homo sapiens
tatatgtgttacatccttatttgaaaaggaatccttgactttgttaggagctctatatatctcctctcatagaaatgccatatattatcaggagactgttaatatctcatgtggaggacccatttgtgcaagcatatctttaaaattaaatattgtcaactattgaacatattcatatttttaaataaaggctacagtaaaccatttgcaaaaaaaaaaaaaaaaacctactagaatgaactttagcaaatgaaaggtgtggtgcttaaagatcattctcagggaactttacaaaaagtccaaaaccaacttatgactggagactgacttaggaaaaaaaattagaggatgaagccaaaactaacacattctaaagaactgcaaggaaagcaactatgtaattctgttgaaaaaggaaagctcaggaaatactctttttatttcttttgattctagctgtctgcgagcctggctgtggtgcacatggaacctgccatgaacccaacaaatgccaatgtcaagaaggttggcatggaagacactgcaataaaaggtacgaagccagcctcatacatgccctga

SEQ ID NO: 667 - DNA, 450 bp, Homo sapiens
  misc_feature 379: n = A,T,C or G
ccacattcattgcatccataaggccgttctccagtatgaattttctggtgaccaacaaggtgagcctgtgtaaggaaggccttcccacattcactacacacataaggccttggcctggtgtgaatcctctggtgctgaagtaggtgagactttctaagaaaagctttcccacattcactgcactcataaggcctttctccagtgtgaattttctggtgttgaacaacattgtatttgaggctgaaggcttttccacattcactacacttataaggcctttctccagtatgatttcgctgatgtttaataaggtcggagttgtacctaaacaatttgccacattcactgcactcataaggcctttcctctgtgtggattntctggtgctcaaacagtgtatgttggtggcaaaagtctttcccacattgggtgcagctgtaattattctgt

SEQ ID NO: 668 - DNA, 212 bp, Homo sapiens
tctgcggggaacagaacatgatcggcatgacgcccacggtcatcgctgagcattacctggctgaaacggagcagcgggagaagttcgggctaaagaagcgggagggggcctgggagctcatgaagaaggggtacacccagcaactggccttcatacaacccagctctgcctttgcggccttcgtgaaacgggcacccagcacctggctgacc

SEQ ID NO: 669 - DNA, 480 bp, Homo sapiens
ccttccccaagactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtc

SEQ ID NO: 670 - DNA, 586 bp, Homo sapiens
cccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcatggtaagatcacgcattgctccagagcacttcactaaccgacccacctgaggagcatgtgcctatcacacaaggaaacctgggaat

SEQ ID NO: 671 - DNA, 567 bp, Homo sapiens
ttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaac

SEQ ID NO: 672 - DNA, 502 bp, Homo sapiens
taagctcgggaattcggctcgaggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttcctt

SEQ ID NO: 673 - DNA, 102 bp, Homo sapiens
cggctcgagagttcttgaccccaaagaaacttcagtgtgtggacctccatgttatttccaatgacgtgtgtgcgcaagttcaccctcagaaggtgaccaagt

SEQ ID NO: 674 - DNA, 509 bp, Homo sapiens
tgacctcggctcactgcaacctccacctcctgggttcaagcgattctcctgcctcagcatcctgagtacaggcactacaggcacgtgagcaagagaagctgacagattcaaatgttcacaaacatttatgttctattttgatagatacataaactatgtttctcattcttatatactttatattagggcatgggattaaagtcaaaatagtggaaaattagtagaaataacatattttatatccaatttagtctccaaaatcccaacatgcactcttctgtatacgtttttcagtatgcttgactggaacggccaattctacagtagtcttggaagcaacatactgcagattaaataccttagtagcctatgttcttgaatgcggacataaaggagcaatgcttttcctatcttaaaaaaacagtttatatgaatgaaacttctgttctgtttaagaattatatgttgttgagtgtagttgtcaaagcaactagcacgattccaagtat

SEQ ID NO: 675 - DNA, 114 bp, Homo sapiens
  misc_feature 70: n = A,T,C or G
catcctcggacgccagcaaggtgacctctaagggggcagggctctcaaaggcctttgtgggccagaaggnaaggttccttcctggtggactgcagcaaagctggctccaacatg

SEQ ID NO: 676 - DNA, 246 bp, Homo sapiens
  misc_feature 47, 49, 69, 138, 169: n = A,T,C or G
tgggggcccaaaggggagcgtggggaggggctgaggataccccaaantncaggctaattagaggatgtngcaggggcagtggcctggatgcacagtgcctgatgcgagtaggctccagacaggaggagtgggacaganagcagctggacttgaaggtttgatgccaaancagacattttcctcacacccacctgctgctgtatgaatagctgtgtatctgtttttccataagattttgataatata

SEQ ID NO: 677 - DNA, 453 bp, Homo sapiens
ataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttg

SEQ ID NO: 678 - DNA, 498 bp, Homo sapiens
  misc_feature 359: n = A,T,C or G
ctcggaattcggctcgagtgaaatgcacccaaaacctcccagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccancctttcggtcttctatttccctatttccagtgctttccagccgggtttctgacccagagggtggaaccggcctggactcctcttcccaacttcctccaggtcatttcccagtgtgagcacaatgccaaccttagtgttt

SEQ ID NO: 679 - DNA, 118 bp, Homo sapiens
  misc_feature 33, 42, 90, 92: n = A,T,C or G
cgtggctgtctcctctctccgccatggcgtgtnctcgcccantgatatcggtgtactccgaaaagggggagtcatctgggcaaaaatgtnantttgcctgctgtattcaaggctccta

SEQ ID NO: 680 - DNA, 485 bp, Homo sapiens
gctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctcc

SEQ ID NO: 681 - DNA, 190 bp, Homo sapiens
aactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttca

SEQ ID NO: 682 - DNA, 248 bp, Homo sapiens
caagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaagcaccctcagcactgacaagggggagtcgctgggta

SEQ ID NO: 683 - DNA, 263 bp, Homo sapiens
gctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgaaaagaacggaggggagcccgatgacgctgaactagtaaggctcagtaagaggctggtggagaacgcggtgctcaaggctgtccag

SEQ ID NO: 684 - DNA, 536 bp, Homo sapiens
cttggtgaaaatagcatagaggaatggattggcacaggagttaagtggatagaagagtaccagcaagattttggagttgctaacagtgatgagaggcttgttcagaattgctgacagagcatagaatgagattggggccatgcatatgaagtcggtgaagatcaacacagccatcctcttggcaattttggtatctttgtcccctgggttgtactgcggatttcggactgtgatgtagatcttcacataacagcagcagacgatgacgaaggcaactatgttgagcgtcagaacaaaaacaatatatgccagagcaagaggggtctcggtgtccatgggcaggcagatactgactttggcatagctacttattcccaccaaaggaagcagggcgagaaggaagcagcaaacccagcccccaaccatgatggcacatgcgtgcctgaggcggatcttccggtccaggcgcatggcgaaggtgatggcataccagcgctccagggtgatgaccgtcagcgtatacaccgataactcgc

SEQ ID NO: 685 - DNA, 247 bp, Homo sapiens
cttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgca

SEQ ID NO: 686 - DNA, 534 bp, Homo sapiens
gggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaacctatc

SEQ ID NO: 687 - DNA, 550 bp, Homo sapiens
actgattacttgattcccttcttcactgtaatatacaaagtgtgtattgtattcagagcaccatggtgttctggttattggttaactctctgtcttctctactagagtgggaactccttaatgataggaatcttattttatacatctctttatttccagagcctcaaaaactgtcaggcaatgaaatgtggatttcggtaatgtctgaaagatgtgttgaaaatgcaagtgatcacattaagcatcagttggatggtaacataagtactaccttcagagttcaaagagatcacttagattggcatggttaaagaagacagaatgaaggagttaaagaaatgagttaaagaatgaatgagggccgggcacggtggctcacgcctgtaatcccagcactttgggaggccgaggtgggtggatcacctgaggtcaggagttcgagaccagctgaccaacatggtgaaaacccgtctctattaatacagaaagttagccgggtgtggtggtacacgcctgtaatccaagctacttgaatcgcttgaacccagga

SEQ ID NO: 688 - DNA, 522 bp, Homo sapiens
  misc_feature 328: n = A,T,C or G
tgtgcacacataaaatactaagaagctaaacttaatatctgcaggtagaagttttaaattcaagattttaaccaaataacagagttaatgctaaaatctcacttttgaagtttatgttgaatattagcattctaatatttaatatttttctatttttgaaataggaaatggaaaagatgcagtaggtttttcaaaagggtatcataggtgagcacttcttatagaagaagaaaactaagaggtagtgctatttacctcttcagcactaagtttatctttatttttatttatttctataaagagatgggagtctcactgtgttgcttangctggtcttgaactcctggcctccagtgatgctcctgccttggcctccgagagtgctgggattataggcatgaggcaccacacccagccagtaatctttagcttctagaaacaatcagatttccttaagattttgcaattaggtttagaggagctcacttgctttttcaaattgggttggatatgtccaaaaaa

SEQ ID NO: 689 - DNA, 266 bp, Homo sapiens
tgccccctccacacccctggtagctctgtgtcctgagaaatccagagtgtgggagacatcactgcatctgtccccccagcttctgtgaagggaagctgtggcctcttttgaatgtggggaacaactgaagactcaggggtcacccagaggtctggtggaaagcaacttcaggtttcatcttgctctattcctcaaaggtctggtctgtgggcctctgaggagaaaacaggtctagccaagacagggacaaaatggggaagggggtg

SEQ ID NO: 690 - DNA, 235 bp, Homo sapiens
ggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattat

SEQ ID NO: 691 - DNA, 237 bp, Homo sapiens
  misc_feature 46: n = A,T,C or G
cttttttcccccccaacaaagtttttttgttttttgtttttttttntaagtagaaattccctccagttttattagcctctttatatgtcgtcaaattgcatgaattttttctggctgttggaaacctgaatgcttttagacccaaatggaaaatttctgaaatgctggattatctatttttaaacaagcagttgacttaaaactttctgtggcaacttctggttttctgacagttcc

SEQ ID NO: 692 - DNA, 547 bp, Homo sapiens
aggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccacagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccacc

SEQ ID NO: 693 - DNA, 590 bp, Homo sapiens
ccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatccctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcct

SEQ ID NO: 694 - DNA, 566 bp, Homo sapiens
cctaatcctccctttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaaaaaaaa

SEQ ID NO: 695 - DNA, 222 bp, Homo sapiens
  misc_feature 110, 113: n = A,T,C or G
gtgaatatagccaagtattccatttattaacaaaataagtcttaccaagggagagctctgttcgtcccaaacaggccccgcagcccccgcgctgccgcatcagaccaganggngggaggagtggggagaagaccccagtcgctggggggtccactctgggggctctgccgggccaggcctaggagagggcgggggctgctgtgatccgagagctccctgacg

SEQ ID NO: 696 - DNA, 266 bp, Homo sapiens
  misc_feature 161, 163, 168, 179, 182, 191, 199, 203, 207, 208, 211, 218,219, 224, 226, 227, 234, 236, 245, 246, 248, 252: n = A,T,C or G
ctagaaggttaggtttatgtatcttgcaggagtcatttgtcactttctaggatgttattccttctggctttgttttagtttctttttaaatgagtaactggccacaatccatgtatacacacattcacaatgacttttctcaacttggtcaattaaaattncncctcnaaaaaaaaganaanaaaaatttncccctaangccnaccnnctngccgggnnggggngnnccacgcngnaattcccanncntttngggaggcgaggggg

SEQ ID NO: 697 - DNA, 248 bp, Homo sapiens
aagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccaccc

SEQ ID NO: 698 - DNA, 257 bp, Homo sapiens
  misc_feature 112: n = A,T,C or G
cggctcgaggggagatgcagcatcccagtttttggtcttctgtcaaaaacacagggatgaggtggtagctgagcacccagatgcttcaggtgaggagattgaagagctgctnaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggacccta

SEQ ID NO: 699 - DNA, 263 bp, Homo sapiens
ggcggttggagcagcagtttgcatcgggtgaaaagaaagcaagggcattcctggcagagggaacagcctgagcaaagccatgcagagaatgaagacctacagaagaaaatgctaatttgaaaaaagatgcataaagcagtctatgttttagtctagtctttttaaacttacagaaatttattactatgtgtgtccatctaacttggcttattttctttatttggggatcaagggaatgccagaattatgatattagttttatt

SEQ ID NO: 700 - DNA, 188 bp, Homo sapiens
  misc_feature 38, 170: n = A,T,C or G
cttcctgtgtaacatctgccatttatttcctcagctgnacaaatctctgttttctctctgttacacactaacatcaatggctttgtacttgtgatgagagataaccttgcctagttgtgggcaacacatgcagaataatcctgttttacagctgcctttcgtgatcttantgcttgcttttttcaaga

SEQ ID NO: 701 - DNA, 215 bp, Homo sapiens
  misc_feature 105, 168: n = A,T,C or G
ggtttctgtgtggagacagtagaatataaaaataacaccttcgctgtctgggatgttggcagccacttcaaaatcagacctctgtggcagcattttttccagaanacaaaagagctatcagcttcccagtttgcacaattcatcaagaaattatgcggggtcactggnacaaatgatgaggctctcctggaagcttaacttcttatccatcccat

SEQ ID NO: 702 - DNA, 278 bp, Homo sapiens
cgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatcc

SEQ ID NO: 703 - DNA, 588 bp, Homo sapiens
tcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgt

SEQ ID NO: 704 - DNA, 211 bp, Homo sapiens
  misc_feature 62, 199: n = A,T,C or G
agcaaatctggctatcttctccatccagtggacctaagcgttatgactggactgggaaaaantgggtgtactcccacgacggcgtgtccctccatgagctgctggccgcagagctcactaaagccttaaaaaccaaactggacttgtcttccttggcctattccggaaaagatgcttgatgcccagcccggtttaaagncattaaaagtat

SEQ ID NO: 705 - DNA, 463 bp, Homo sapiens
ctcgcccgacagcatagtacttgccgcccagccacgcccgcgcgccagccaccatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaat

SEQ ID NO: 706 - DNA, 652 bp, Homo sapiens
ttgcagcctgcccagcagcagcagcaacagcagcagcagcattccctactgtctgcaccaggccctgcccaggccatgtctttgccacatgagggctcttctcccagtttggctgggtcccaacagcagctttccctgggtcttgcaggtgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacagacctggacaaatttgctgcagaagatatcattgatcccattgcaaaggccaagatggtggctttgaaaggcatcaagaaagtgatggctcagggcagcattggggtggcacctggtatgaacagacagcaagtgtctctgctagcccagaggctctcggggggacctagcagtgatctgcaaaaccatgtggcagctgggagtggccaggagcggagtgctggtgatc

SEQ ID NO: 707 - DNA, 321 bp, Homo sapiens
ggtgaggggaacctcactttgaacgactgtggggacatgttttccgcgctctgcgagtcggctccccgagagctcaaggcaaactatgccttcaagatctatgacttcaacactgacaacttcatctgcaaggaggaacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctg

SEQ ID NO: 708 - DNA, 464 bp, Homo sapiens
agttatgcggtcaacagcatcaaacaatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgcta

SEQ ID NO: 709 - DNA, 446 bp, Homo sapiens
cagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccaagggcggccgccgactagtgag

SEQ ID NO: 710 - DNA, 311 bp, Homo sapiens
aaaaagctataaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagctgtggatttaattgatgc

SEQ ID NO: 711 - DNA, 511 bp, Homo sapiens
cgcagtgtcgctcactaccgccgctgttgccttcggtgatgaggcaaagaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttca

SEQ ID NO: 712 - DNA, 581 bp, Homo sapiens
acacaccttactcaacatcaaaaaattcatacctggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttca

SEQ ID NO: 713 - DNA, 530 bp, Homo sapiens
tcggctcgagcaagtcttcactgccttcctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagcgggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcagagacatggcagcagtgcagaggaccctgatggctttgggcagcttggcagtgaccaagaatgatgggcactaccgtggagatcccaactggtttatgaagaaagcg

SEQ ID NO: 714 - DNA, 509 bp, Homo sapiens
gaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattactatttggtatgattcagtttttaatgttattttaaacttcttatatggttggcatatttctgaaaatttaattccaaagaggaattaaccaaactgtacaggacaatattaaccccttctgtactctagaaatatttatactccttttaaaaaaacctgcctttggccgggtgcattggctcacacctgtaatcccagcactttgggaggccaaggcgggtggatcacgaggtcaagagatcgtgaccatcctggccaacacggtgaaaccctgcctctactaaaaatacaaagattagctgggcatggtggtgcttgcctgtaatcccagctgcttgggaggct

SEQ ID NO: 715 - DNA, 87 bp, Homo sapiens
  misc_feature 18, 42, 47: n = A,T,C or G
cccaagatgccgaaaggnaagaaggccaagggaaagaaggtngctcnggccccagctgtcgtgaagaagcaggaggctaagaaagtg

SEQ ID NO: 716 - DNA, 137 bp, Homo sapiens
  misc_feature 20, 49, 53, 86, 90, 103, 106: n = A,T,C or G
ggcggaggtgcaggtctggngttgatggtcgaggccatctcctgggcgnctgncggcatcgtggtaaacaggtatgctgggcgganggtngtggtcgtacctntgnaggcatcaacatttctggcaatttctacaga

SEQ ID NO: 717 - DNA, 269 bp, Homo sapiens
  misc_feature 123: n = A,T,C or G
ggtcagggaccttctcaggtacttctactcccgaaggattgacatcaccctgtcgtcagtcaagtgcttccacaagctggcctctgcctatggggccaggcagctgcagggctactgcgcaanctctttgccatcctcctcccccaggacccctcgttccagatgcccctggacctgtatgcctatgcagtggccacaggggacgccctgctggagaagctctgcctacagttcctggcctggaattcgaggccttgacgcaggccgag

SEQ ID NO: 718 - DNA, 98 bp, Homo sapiens
  misc_feature 12, 39, 65, 76: n = A,T,C or G
ggaggacttggngccccctccacccatcattgacaagancttcatggacacgctgcccttctganccctgcctggnaacacgtgtgcacatgcgcact

SEQ ID NO: 719 - DNA, 654 bp, Homo sapiens
  misc_feature 484, 570: n = A,T,C or G
cccacacatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtanccaacatcacaatctatgacgaggaagcgatggtggaggctgtggccctctacaaccctgtgagctttgcctttgaggtgactcangacttcatgatgtatagaacgggcatctactccagtacttcctgccataaaactccagataaagtaaaccatgcagtactggct

SEQ ID NO: 720 - DNA, 310 bp, Homo sapiens
ttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcattcaaccctcgcttcaacgcccacggcgacgccaacaccatcgtgtgcaacagcaaggacggcggggctgggggaccgagcagcgggaggctgtctttcccttccagcctggaagtgttgcagaggtg

SEQ ID NO: 721 - DNA, 271 bp, Homo sapiens
tccaccagtgcttcctggcacaggtcggccgggctgcttcacttcttgtttccagagattcacggcaccagtccccctctggtacccagcctgacagggccatgttggtgggaccaaagctgtactgttgtttatgacgtgtttcatgtcagtatttcaggcccacccactgggctccccctcccagattgccaaagttgtggagtctgtttttcttagttgaatgtcttagttctctgggataggtgaacagatctcaagagcaaggaac

SEQ ID NO: 722 - DNA, 569 bp, Homo sapiens
attccaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatcctttttttttttttttttttttttaaaaaaaaaaattttttttttttcccccccgggaaaaaaaaaaagtttttttttttttttgaaacccccccccccccaaaaaaaaaaattttccccccccccccccccttaaaggggggaaaaggggggccccccccccccccccattttttttttttttttaaaaaaaaaaaggggttcccccggggggggaaggggggggtttttttttgccccggggaaccccccccccccccccccaaaaggggggggttaaaagggggccccccccccccccggggggttttttaaaatttttaaaaaaccttttaaccttttttttttggggggggg

SEQ ID NO: 723 - DNA, 207 bp, Homo sapiens
  misc_feature 181: n = A,T,C or G
ggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccaganccaagagtacaagatgctgctggaca

SEQ ID NO: 724 - DNA, 560 bp, Homo sapiens
gaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatctgcaaaggtgacatctttattgtctatgacaccagattcgtcttctcagaagtgaatggtgacaggctcatctggttggtgaagatggtgaatgggcaggaggagttacacataatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacaaaatgtcaacatcttgggctcctttg

SEQ ID NO: 725 - DNA, 565 bp, Homo sapiens
gaggctgtaatgaaatattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatga

SEQ ID NO: 726 - DNA, 599 bp, Homo sapiens
ggatgggcaccctgctcatcagcaagatccgggaagagtacccagcaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggat

SEQ ID NO: 727 - DNA, 555 bp, Homo sapiens
gtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctg

SEQ ID NO: 728 - DNA, 215 bp, Homo sapiens
cggctcgagatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagat

SEQ ID NO: 729 - DNA, 287 bp, Homo sapiens
  misc_feature 212: n = A,T,C or G
tgaaatactttcctggggcacacaggcaagtttacaaaaacctacaggaaatcaatgcttacattggccacagtgtggagaagcaccgtgaaaccctggacccgagcgcccccagggacctcatcgacacctacctgctccacatggaaaaacggaaatccgacccacacagtgaattcagccaccaaaacctcatcatcaacacgctctcnctcttctttgctggcactgagaccaccagcaccactctccgctacggcttcctgctcatgctcaaataccctcat

SEQ ID NO: 730 - DNA, 544 bp, Homo sapiens
acccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctg

SEQ ID NO: 731 - DNA, 302 bp, Homo sapiens
gttttcaaagtaaataccttaatcaaatttggaaatagtatttatggattttattcaacatagattatctattttgttaaaattatagaaatgaacagttcttttcccatggatgccttttttcatcttggcctattctgatcctttaagaacaagctttgtcctttcattaatacttctcacctataattacgaattttctctaaacttgtagattttattatccatgccatctatttataatcctatgacactcctatattgtttatggtttttttgtttttttttgttttttttttaaa

SEQ ID NO: 732 - DNA, 438 bp, Homo sapiens
gcgaaaatggaaaacagaatcaggatttggaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgtcatagttgttggagttgcagtaatttgtgttgtcccgtacagatatcttcaaaggaggaagaagagagggaaagcagatggtggagctgaatatgccacttaccagactaaatcaaccactcca

SEQ ID NO: 733 - DNA, 269 bp, Homo sapiens
aaccaatactgaagttcaaaagtatcgaagaagtgatacaaagagcgaatagcaccgactatggactcacagcagccgtgttcaccgaaaaatctcgacaaagccctgaagttggcttctgccttagagtctggaacggtctggatcaactgctacaacgcgctctatccacaggctccatttggtggctttaaaatgtcaggaaatggcagagaactaggtgaatacgctttggccgaatacacagaagtgaaaactgtcaccatcaa

SEQ ID NO: 734 - DNA, 93 bp, Homo sapiens
  misc_feature 11: n = A,T,C or G
atctgattaanaaaaaaaaatactgattccttgtagcaacccaaaaaatgtaaagaaagaattcgacacaatggggttgcgtcacctatagtt

SEQ ID NO: 735 - DNA, 500 bp, Homo sapiens
tgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttttttaaaaaagtctcgctgggccccccagggggggggggaggggggcaatctcacgggttccttggcccccggggttaaagcaattttcccccctaaccctccggagaagcggggataacaggccccccccggtgttaatttttgttttttaagaaaaaaggggg

SEQ ID NO: 736 - DNA, 539 bp, Homo sapiens
taagctcggattcggctcgaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaatacccctgggtgtgtgcaaatacactgtccaggatgagagccactc

SEQ ID NO: 737 - DNA, 545 bp, Homo sapiens
agctcatctgcgagtgtggcctctttgaaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgccccccaaccatgcgagccccgccaccgactgccaagggcgtggtgaccattgagcagatcgtggacacgctgcccgaccgcgg

SEQ ID NO: 738 - DNA, 586 bp, Homo sapiens
gctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaa

SEQ ID NO: 739 - DNA, 219 bp, Homo sapiens
  misc_feature 48, 200: n = A,T,C or G
gtgttctgctagtaaatagttgaaggttgatcattgatctcctgcgtnttcagtctggcatggaaaagcccccgtgcaactggtaaagatatcaataagcaccaggaggtatctaaatccaccaggagccataggcatcacattgacgtccatttaccagtcttccctggcaagattcttctgaattgtgctgccttgtnccaaaagaggtatgggagg

SEQ ID NO: 740 - DNA, 109 bp, Homo sapiens
  misc_feature 33: n = A,T,C or G
agcaattagaattttaacactggcagttatgantaatatgaaggagaggtagatttctgagtgattctggtttaaccagctgggtggatggtggttccacgtattcagg

SEQ ID NO: 741 - DNA, 197 bp, Homo sapiens
cctcataaacctagagtcagagagtgcactatttaacttaatgtacaaaggttcccaatgggaaaactgaggcaccaagggaaaaagtgaaccccaacatcactctccacctgggtgcctattcagaacaccccaatttctttagcttgaagtcaggatggctccacctggacacctataggagcagtttgccctgg

SEQ ID NO: 742 - DNA, 274 bp, Homo sapiens
  misc_feature 49, 257, 260, 261: n = A,T,C or G
ggagaccatgacaatgacaaggaaagcgatgtggagatttaagagtggnttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacngtnnaggaaagctatct

SEQ ID NO: 743 - DNA, 271 bp, Homo sapiens
cctctcaactcatcactccttttgcctagatgggatctgctgcaggcaagatattcccggcctcagaagctgaggggagaaccttctgttcttccccaccttcggcttgcattcctccttcagcatcttcttaaggacagtttctactgcacagtgatcaaagttgcagaggggtgaagtgtggatatccaggaacccccattttactgttactgtctttactgcactttccactatccagggagggtagtttatgcccttgggtgctttg

SEQ ID NO: 744 - DNA, 309 bp, Homo sapiens
  misc_feature 26: n = A,T,C or G
acacaactgtgttcactagcaacctncaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcaactttgccacatgagtga

SEQ ID NO: 745 - DNA, 430 bp, Homo sapiens
gcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaaaaaaaaaaaaggggggcccc

SEQ ID NO: 746 - DNA, 262 bp, Homo sapiens
  misc_feature 21, 24, 27, 33, 51, 71, 80, 121, 143, 170, 182, 188, 196,208, 228, 246, 251, 252: n = A,T,C or G
cgtcctcgtggaagtgacatngtnttnaaaccntgcgtggcaatgcctgangcaccgccgtgatgccccanggaagacanggcgactggaagtccaactacttcttaagatcatccaatantggatgattatcgaaatgtttnattgtgggagcagacaatgtgggctanaagcagatgcancagatncgcatgtncttcgcgggaangctgtggtgtgatgggcaanaacaccatgatgcgcaangccanncgagggcact

SEQ ID NO: 747 - DNA, 632 bp, Homo sapiens
taagctcgggaattcggctcgagcggctcgaggcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgatatca

SEQ ID NO: 748 - DNA, 299 bp, Homo sapiens
cattaacctacactcttccggacggctcttaaaacttgcaggacataatgaaattgggaagagcagagtgttgaagtctatagcatggccttctgcttgaccctgagttcctgaattgaatgtgggagaccacaggccatacttctctaggcactcacatgtctcccttggcataaggaaacatgttagtaatatagttttttagatccaaacagtttatttggatctaaaagtttaagtgttcagttgaaaaacagctattgattttattagtagcaaattatcaccattaaagccag

SEQ ID NO: 749 - DNA, 396 bp, Homo sapiens
actgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatc

SEQ ID NO: 750 - DNA, 314 bp, Homo sapiens
cgcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagc

SEQ ID NO: 751 - DNA, 245 bp, Homo sapiens
  misc_feature 163, 171: n = A,T,C or G
gggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgcnacggatcnctttgtggccttccacatcaacaagggccttgtgaagaagtatatgaactctctcctgattggagaactgtctc

SEQ ID NO: 752 - DNA, 465 bp, Homo sapiens
cgagacaaccccagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggtgagcggggaagctggtcggtctgtgggagggggcatttgtttggaaaatgcgggtttcaggccaagctcggtggcccacatctataatcccaatgctttggaaggctgagggaggaggattgcttgagcccaggagttcaagatcagcctgggcaacatagcaagaccttttctctacaaaaaaaaaaaaaagggggggcccc

SEQ ID NO: 753 - DNA, 552 bp, Homo sapiens
agctcggaattcggctcgagtctgctcagcctggtgaacccacaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgca

SEQ ID NO: 754 - DNA, 505 bp, Homo sapiens
caacacgctgggctaccacgtccgccaggagccgcggagcatgagcaagaggctcttcctcgtaacgcgagcccagtcccccttcaaagtttatcattaccagttaaagatccagttcatcaaccaaactgagacgccaatacaaacaacttttaccatgtcactactcggaacaaaagagaaaatgcaaaaaattcccatcactctggaagtaagaggtgtagccccctagggtgatgacatttatttttcttgcagaacataaatggactctgtaattttcaagaggcaggccagctacaactactttattccagacgcaaaccagaggtatctgagacacatgtcaatcaatttagtttattttgccaaagttaaagacgttatcgagacacagcctcaggaggtcctggtgacctgtatccaaggtggtcaggctacagcttggctctatacattataggaagatataagacatcaatcagtacttgtaagatgtacactg

SEQ ID NO: 755 - DNA, 394 bp, Homo sapiens
taagctcgggattcggctcgagtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtc

SEQ ID NO: 756 - DNA, 389 bp, Homo sapiens
ggaacgtggtgatgttcgtcacctatgagcagctgaaacgagccttctacaaagggttcatgccctcctttctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggaaaaaaaaaaaaaaaaaaaa

SEQ ID NO: 757 - DNA, 547 bp, Homo sapiens
  misc_feature 461: n = A,T,C or G
tttcttactgtacctcagggcttagtgaaagtaatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttantatgtcaaaagcacattatgaagcagaaattaaaatagccaagaggcccagaaatctaaagatctttgttctataactgtaagtgg

SEQ ID NO: 758 - DNA, 437 bp, Homo sapiens
cccctttgctatctagaatgtgtatgccatagaatactggatagaggtaggatcagcagctaatctatgagaaattttgtatgattagacacaaaaaattgaatgcttatcctaccgtccagtaaaaaatatttttcggtgtccccaaaaatagcaatttattaatggaaaaatataattttatcactaccactttttaatgctacaagtttctccaggagcaaaggataagaagaaaaagagaaattttaataagttattattattattatttttgagacagtctcgctctcttgcccaggctggagtgcagtggctccatctcagctcactgcaacctccgcctcccgggttcaaacagttctcctgcctcagcctcccaagtagctgggaatacaggtgcacactgccacaactggttaatttttttttttttt

SEQ ID NO: 759 - DNA, 237 bp, Homo sapiens
  misc_feature 12, 16, 17, 55, 61, 71, 85, 91, 103, 108, 109, 110, 153,174, 175, 177, 185, 196, 199, 214, 221: n = A,T,C or G
cacttccaccanccanntaccctcaactgccacttcacagtcctgccaccactantcatgnaaatgccacngttcatccaacaancaacancactgccaccancccannnattcaccagttctgcccacccacaaccacctccaccctctccnagtcctagcccaacctccaannanaccattgngagactacacnttnaccaatggttcccanccctgtntccacctccaaaccca

SEQ ID NO: 760 - DNA, 611 bp, Homo sapiens
gctcgggaattcgctcgagattacagtacccaggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggt

SEQ ID NO: 761 - DNA, 275 bp, Homo sapiens
  misc_feature 19, 21, 69, 77, 144, 156, 174, 176, 177, 248, 259: n = A,T,C or G
caacaccaaggtggacaananagttgagctcaaaaccccacttggtgacacaactcacacatgcccacngtgcccanagcccaaatcttgtgacacacctcccccgtggcccacggtgcccatagcccaaatcttgtgacacanctctcccatgcncacggtggcccagaggtnanntcttttgacacacctcccccgtgcccaatgtgcccagcactgaactcctgggaggaccgtcagtcttcctnttctccccaanacccaaggataccctt

SEQ ID NO: 762 - DNA, 565 bp, Homo sapiens
gctcggaattcggctcgagaaagattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgtgagtgccgcccgccccccgcgtgccctgctgcccgccccgcctggcacgtccacctctgccccttaagcctaaagcctgtgcctgagccttccctggtgaacaccagtcccctgtgttatcattatgctggtgtccataaatcgaacctggccctttttcctcttcatctctctggatcctcccaaccaccctctgaagcaggtggtcttgtttccacttcacagggaagaaactgagctcagagagggaaagagacctgcccagggtc

SEQ ID NO: 763 - DNA, 261 bp, Homo sapiens
atcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataaatgttaaccaagtcacagtgtttttggttttgtttttctgaaatcttggtttgatcaaatctttttttttttcttttgaaagggagttttactttgtcccccaggtt

SEQ ID NO: 764 - DNA, 164 bp, Homo sapiens
atttattcttccgttagagttgatacagttttaaatagcaacaaagtacacagtggtggaaaattggcacagaacctacaagcatttcaatcacaataaggctgtccatgatttatctgttcaaacttgatgtccattttctactgatcaagttgaaagaaaaa

SEQ ID NO: 765 - DNA, 530 bp, Homo sapiens
taggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatggg

SEQ ID NO: 766 - DNA, 394 bp, Homo sapiens
aagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatca

SEQ ID NO: 767 - DNA, 500 bp, Homo sapiens
cacattataataattcccagagcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggac

SEQ ID NO: 768 - DNA, 391 bp, Homo sapiens
tccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaagactcgctcagcagcagcctgaaaacttgctacaagtatctcaatcagaccagtcgcagtttcgcagctgttatccaagcgctggatggggaaatgcgcaacgcagtgtgcatattttatctggttctccgagctctggacacactggaagatgacatgaccatcagtgtggaaaagagagtcccgctgttacacaactttcactctttcctttaccaa

SEQ ID NO: 769 - DNA, 430 bp, Homo sapiens
tttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaattttttttttcaatctaaaaactggaaattctagggtttttgtacattttggatgcactgggaatttattagcacaaaatcattctttgcaactcaaaattcaaaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagc

SEQ ID NO: 770 - DNA, 157 bp, Homo sapiens
cagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcaga

SEQ ID NO: 771 - DNA, 257 bp, Homo sapiens
gcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattcta

SEQ ID NO: 772 - DNA, 545 bp, Homo sapiens
aaatatatccttgttttccacactatgtgtgttgttcccaaaagaatgactgttttggttcatcagtgaattcaccatccaggagagacggtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattg

SEQ ID NO: 773 - DNA, 223 bp, Homo sapiens
gagcatgattttgggtctgcccaaaggaacatggtgtcacttttgttctttctgacccactaaataaaaagtagtgtaacagggtttcactggaatgtttattagaaagtttacactttttatatttttatgattttaaaaacaaacaataatagaaaaacagattttaaggaacttcagagcagtatatattctgtctaaactcactgaatattttaagttg

SEQ ID NO: 774 - DNA, 477 bp, Homo sapiens
ggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccagtgagtccccgccctgcctgcgcatgcacccgagaggttcgggctgtgtaacctgtgcgggcttctctggtgccctctctcaggactccttggggaacctgggtgtctcgccttctgctgcctcagggcctgggcgtctctgcccggctgccatgagtgctctccttcctggctttg

SEQ ID NO: 775 - DNA, 421 bp, Homo sapiens
ccgctgcgtgttttccttttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggaaaaaccccaaccccgttggttaaattttttttttttaaaaatttggaaggggaaaaaattttttttaatctaaaaaaaaaaaaaaaaaaaaaaaaaggggggggggg

SEQ ID NO: 776 - DNA, 437 bp, Homo sapiens
agtttgaagaaaccacagctgatggcatgaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgggttcaattatctttatcataaacattttacatgcagctttttcaaagtgtgttggattaattaggatcatccctttggttaataaataaatgtgtttgagctaaaaaaaaaaaaaaaaaaaaaggggggccccccctt

SEQ ID NO: 777 - DNA, 542 bp, Homo sapiens
gagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtg

SEQ ID NO: 778 - DNA, 558 bp, Homo sapiens
ttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggtaagtaaatgactaaatatatttcatttcttttggggtaaggatgtcaagaacattgtaaaagaacataaattattgagtttgtatagcctctttgaggctctgtgtttttcatctgtaataacagcagcaacaacaaaatcctaattgagagtttgtgatcagtgttgtaaaagaggatttatgagaagaaatttacacagtgtctagcacagcactactatttgtgaagtaattgaataattgaatgatgatgatgatacgtctacaaagtttgcttctttgtgtaaggtacttttgtggcttctcctggtcttctttataagtccagatttcttgccattttatacaaggcatgtccctttagccactcacccacacccatctt

SEQ ID NO: 779 - DNA, 198 bp, Homo sapiens
  misc_feature 27: n = A,T,C or G
agtgccaggagaattttgacgtgaatnagtatctccggaagatggtacgaaattgagaagatccccaacaacctttgagaatggacgctgcatccaggcccaactactcactaatggaaaacggaaagatccaaagtgttaaaccaggagttgagagctgatggaactgtgaatcaaatccgaaggtgaagccacccc

SEQ ID NO: 780 - DNA, 283 bp, Homo sapiens
  misc_feature 11, 35, 42, 49, 60, 61, 62, 64, 78, 84, 93, 94, 100, 125,137, 142, 143, 167, 207, 210, 217, 257, 265, 269: n = A,T,C or G
agatggagcancagaaccaggaatacggaatcctnctggatntgaagangcggctggagnnngnggttgtcacctatngccgcnggctggagnnagaggntgaccgcctgacctcagtacaaganagaaccggtgancatcnncaggtgcgtaccattgtggaagangtccaggatggcaaggtcatctcctcccgcgagcaggtcnacnagatcanccgtgaggactcagctaccccggccggccacccaggaggnagggaggnagcngccccatctgccca

SEQ ID NO: 781 - DNA, 563 bp, Homo sapiens
aattatgtcttggaaaaagctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggacctt

SEQ ID NO: 782 - DNA, 197 bp, Homo sapiens
  misc_feature 16: n = A,T,C or G
agaagggaaaggtctnaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaag

SEQ ID NO: 783 - DNA, 240 bp, Homo sapiens
  misc_feature 191, 237: n = A,T,C or G
ctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggnactttgcaaggattgtggagttaaatattctgggtttcctcctacnacg

SEQ ID NO: 784 - DNA, 301 bp, Homo sapiens
ggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaatgaccattcagaacagacaggcccagattgaggtggtgccttctgcctct

SEQ ID NO: 785 - DNA, 263 bp, Homo sapiens
  misc_feature 56: n = A,T,C or G
tggtacgcctgcaggtaccggtccggaattcggctcgagaaacatgctaaaccaanaaacatccaatcacaaaactaggaagtttggcaagaagtggttagagaaatctctgggcttttccatgggcagggtcgacagactctcttttcagtgatttctggctctgagaaacctctttactcactagaaaagaactttatttaaatggccaattttgttcctcagaaaaagaaattaaaaaaaaaaaaaagggggggcccttt

SEQ ID NO: 786 - DNA, 424 bp, Homo sapiens
tggtacgcctgcaggtaccggtccggaattcccgggtcgacccacgcgtccgattctatttcagtgacgtaggttggggctgaatgtaaaatagacatcatattactaaatagaatcctataaaatgcaatcacaggtgcccgggagtactagttttaaacatttccttaacaaggagaacaatccagcaaaaagctttctttctctatacagtgtatatctctaaactttttttcctcagttttagagaacatctgttttatctggtggttctttgtttgaatgcaaactcataactttcaagtctccggtgcaagagcataatctacagatcatgggcaaaatctagccacagtcctgagagtccaggcttctgggatgcccagctgggtataaaagtccctactaaccctgtttcaaattc

SEQ ID NO: 787 - DNA, 245 bp, Homo sapiens
  misc_feature 89, 94: n = A,T,C or G
ggaagccaggagccgagcccatgcagtggagggccaggtggaagatgtggttgggaacctgcggcaggggacagtggcactgcaggaanctcangacaccatgcaaggcaccagccgctcccttcggcttatccaggacagggttgctgaggttcagcaggtactgggccagcagaaaagctggtgacaagcatgaccaagcagctgggtgacttctggacacggatggaggagctccgccacca

SEQ ID NO: 788 - DNA, 260 bp, Homo sapiens
cgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagc

SEQ ID NO: 789 - DNA, 519 bp, Homo sapiens
gatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctc

SEQ ID NO: 790 - DNA, 252 bp, Homo sapiens
  misc_feature 144: n = A,T,C or G
agcccaagccctcagtggaacctgtcaagagcatcagcagcatggagctgaagaccgagccctttgatgacttcctgttcccagtgacacttcagagagctggtagttagtagcatgttgagccaggcctgggtctgtgtctcntttctctttctccttagtcttctcatagcattaactaatctattgggttcattattggaattaacctggtgctggatattttcaaattgtatctagtgcagctgattt

SEQ ID NO: 791 - DNA, 266 bp, Homo sapiens
  misc_feature 119: n = A,T,C or G
ccggctcccgatggccagtttgctttcctcattcccaacggggccttcgcgcacagcggccctgtcatccccgtctacaccagcaacagcggcacctccgtgggccccaacgcagtgtncaccttccagcggcccctcgcttacggcggactccatgtggaggccgtggcggaactgagggggctcaggccacccctcctcctaaactccccaacccacctctcttccctccggactctaaacaggaacttgaatactgggagaga

SEQ ID NO: 792 - DNA, 907 bp, Homo sapiens
  misc_feature 164: n = A,T,C or G
tgactttttaaagaagtaagcctttatttccttgttttgcaaataaaactggctaagttggttgctttttggtgattagtcaaagagaccaaatcccatatcctcgtccgactcctccgactcttccttggcttcaaccttagctggggctgcagcagcagagngagcagctgtggtggcagcagcacaggggcagcagcacaaaggcagatggatcagccaagaaggccttgaccttttcagcaagtgggaaggtgtaatccgtctccacagacaaggccaggactcgtttgtacccgttgatgatagaatggggtactgatgcaacagttgggtagccaatctgcagacagacactggcaacattgcggacaccctccaggaagcgagaatgcagagtttcctctgtgatatcaagcacttcagggttgtagatgctgccattgtcgaacacctgctggatgaccagcccaaaggagaagggggagatgttgagcatgttcagcagcgtggcttcgctggctcccactttgtctccagtcttgatcagctgcacatcactcaggatttcaatggtgcccctggagattttagtggtgatacctaaagccctggaaaaggaggtcttctcgggcccgagaccagtgttctgggctggcacagtgacttcacatggggcaatggcaccagcacgggcagcagcttgcaccttatttggccgcaacctgtccctgatctcagtgagagtcctccttggtgaacacaaagcccaaatgcccccggttaatgaggaagcaattcttcagaggctgggttgttttccaggtggcctcggatgggcctggcccattcatggttttttgccccatcaaaacacaagcttccccccagggaacaattcggatct

SEQ ID NO: 793 - DNA, 366 bp, Homo sapiens; identical to SEQ ID NO: 350
  misc_feature 112, 139, 177, 193, 211, 261, 302: n = A,T,C or G

SEQ ID NO: 794 - DNA, 578 bp, Homo sapiens
gcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagccataaaaatccccaaatatgttcaaggacttcataattgaaaaatatatagaaaacaatccttacttctttttacaaaaacaaaatcatgggaattattcttttctatatatttagttataaatctttctctgggccgggcgtggtggctcacgccagtaatcccagcactttgggaggctgagacaggcgaatcacgaggtcaggagttcgagaccagcctggccaacatggtgaaaccccgtctctactgaaaatacaaaaaattagctggacacggtggcaggcgcctgtgtgtggcgggcgccagctactcaggaggctgaggcaggagaatcgcttgaacccaggaggcagaggttgcagtgagccaagattgcgccactgcactccagcct

SEQ ID NO: 795 - DNA, 232 bp, Homo sapiens
tttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggc

SEQ ID NO: 796 - DNA, 247 bp, Homo sapiens
gttcgaaactttggaactctagatagaaaatatctcttggcacttaatctgctactaatttttgctgttaaatcagatggatcaaactttgtgtttaatagctaaatgttgaatctgaaatggatgacagaccaaagttaaacaagcctccggaaactcttatcactactattgattctagttccagttggtggaccaactgggtgatccctgccatctctgcagtggccgtcgccttgatgtatcg

SEQ ID NO: 797 - DNA, 461 bp, Homo sapiens
gtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcagttaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcct

SEQ ID NO: 798 - DNA, 465 bp, Homo sapiens
ccaagaattcggcacgagacaaggttttcaggctcccaggtcagtagaccaaaccaacttccttagatttttttttttaagctgtttgcaaaaaactgggtggtagcgtgtctgaaccaaacggaagaatagccagcggagcatggactgttccagcacgggccaaatggccagctgtcgaaagcagccctgcccagattgcggtgggggctgagccatcggctccgcagggcccttccaactctggagtgtctgtagttcttgtgaaaccaaaacgttgactacctgcctctttcctcgggcatcaacgtgctcatttccaaaaatgatggtgcaggtgaccttttccatcgtgagctaaaaaaaggttaggaggcctgaggggcggtccttgtgtcccctcctccccctccacagcccctgaggtggagcttccctcacagaccccatttggtcgagcctacg

SEQ ID NO: 799 - DNA, 660 bp, Homo sapiens; identical to SEQ ID NO: 286
  misc_feature 595, 605, 621: n = A,T,C or G

SEQ ID NO: 800 - DNA, 567 bp, Homo sapiens
gcaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaa

SEQ ID NO: 801 - DNA, 502 bp, Homo sapiens; identical to SEQ ID NO: 284

SEQ ID NO: 802 - DNA, 461 bp, Homo sapiens
tggatcccccgggctgcaggaattcggcacgagcttagagctcattttgttttatctcctcattgtatggataaagtgtagtgcaaaagagtgagttctaggccagaggtaggccaataatttaattttcccaactcacgggccaaggttctttccactgcaccataatactgatccccaattttaaggttccttgtctgtccttctaaaccatcaattcactcaacaactgcttaagtgtatatagtatgtgcacatctgtgccatttgttgggtatgcaaagtctaaaagacagggtgcctgccctgagatgctcatgacctaattcaaatgcatccttcctgtccctctccccacttctcctggatcttctcatctgtatccttttccacgtttgtaaatataaattcaatagaaataaacagttttatatatggcaaatcatgatgagctatgaaag

SEQ ID NO: 803 - DNA, 374 bp, Homo sapiens
tggtacgcctgcaggtaccggtccggaattcccgggtcgacccacgcgtccggaggggtcctggagaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggat

SEQ ID NO: 804 - DNA, 267 bp, Homo sapiens
  misc_feature 109: n = A,T,C or G
gccagctttagcttgtggaaaagtccatctaggtatggttgcattcagattccaaagagaatcatttacaagttaatttctgtctccttggtccattccttctctctantaatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctctt

SEQ ID NO: 805 - DNA, 269 bp, Homo sapiens
  misc_feature 13, 47, 149, 150, 170, 192, 194, 224, 232, 234, 237, 241,245, 263: n = A,T,C or G
ggccgcagaagcnagatgacgaagggaacgtcatcgtttggaaagcntcgcaataagacgcacacgttgtgccgccgctgtggctctaaggcctaccaccttcagaagtcgacctgtggcaaatgtggctaccctgccaagcgcaagannaagtataactggagtgccanggctaaaagacgaaataccacngnaactggtcgaatgaggcacctaaaaattgnataccgcngnttnaggnatgnattccgtaaggggacaanacctaa

SEQ ID NO: 806 - DNA, 401 bp, Homo sapiens
ggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactgggatgaatggacgatgt

SEQ ID NO: 807 - DNA, 641 bp, Homo sapiens
  misc_feature 85, 350, 436, 457, 467, 500, 507, 557, 563, 581, 589, 608,641: n = A,T,C or G
gaacacagacagactcgcgagttgctggacctctttcggtattaagtgtttgaatccatggtgggccttttgcaagtagcgttantcatcttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggcttgttttcctcttactcttactttaaccatgtgcctggaggaagccattctgggctcttgcacttgcccagcctttctttgccagggnaagagaagggaaaagggggtagattgagtgttgccaagggccgttgcaaagggcaggcttgctttccacccatctgctgagggaancctctcctctcgctcctttgnctctgttcanactgttgtcttggaagaagatggtcccttgtcntaaggcntttgtgataaagtcatctcagttaggatctgcacctgtttccctcgtaanagtgcnggcggccttttgaattanagtggttngaacccctcgcatgagaanactggtagattattttgcaagtgggtggttaan

SEQ ID NO: 808 - DNA, 393 bp, Homo sapiens
  misc_feature 203, 244, 303, 327, 352, 372: n = A,T,C or G
agacctactgccagcgcacgttccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttnctctaccagatcctgcggggcctcaagtacatccactccgncaacgtgctccaccgagatctaaagccctccaacctgctcatcaacaccacctgcggancttaaggatttgtgattttcggcntgggccggatttgccgatcctgagncatggaccacaccggctttnctgacggataatgttgggtta

SEQ ID NO: 809 - DNA, 431 bp, Homo sapiens
tgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttatcgaggtgtgcaacgggaaactgtacatcgtgatggaagcggccgcaagcttattccctttagtgagggttaattttagcttggcactggccgtcgttta

SEQ ID NO: 810 - DNA, 553 bp, Homo sapiens
cccatgcgcatcggcaacaacggggggtgagagcccagtgacattatcatcccgctaaggactgcggacagcgtcttctgccctcactactagaaggtcagcggggactactggcacccggtgtacatcgtccaggagatgcccccgcatagcccggcgaacatttactacaaggtctgagagggaccctggtggtacctgtgctttcccagaggacacctaatgtcccgatgcctcccttgagggtttgagagcccgcgtgctggagaatagactgaagcacagcaccgggggagagggacactccttctcggaagagcccgtcacgctggacagcttacctagtcttgtagcattcggccttggtgaacacacactctccctgaaagctggaagactgtgcagaagacgcccattcggactgctgtgccgcgtcccacgtctcctactctaagccatgtgctgcggtcactcaggcctctgcagaagccaagggaagacagtggtttgtggactagagggctgtgagcatcctggcaggtgccccaggatg

SEQ ID NO: 811 - DNA, 272 bp, Homo sapiens
  misc_feature 257: n = A,T,C or G
cagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgttctcgctggccagggcaacaacgnctatttctgtaccag

SEQ ID NO: 812 - DNA, 198 bp, Homo sapiens
cttgatgaactccaagttcacagtgtcatttcttcagaactccccttcattgaatagtgatcatttattaaatgataaattgcactcgctgaaagagcacgtcatgaagcaccatggaatcaaagagaaagatataaattcgtcccagagcttaggcggtgttaagtgaaaaaaaagaagttcggtaaaaggcctcgc

SEQ ID NO: 813 - DNA, 208 bp, Homo sapiens
  misc_feature 97: n = A,T,C or G
gactacatcttggacctgcagatcgccctggactcgcatcccactattgtcagcctgcatcaccagagacccgggcagaaccaggcgtccaggacgncgctgaccaccctcaacacggatatcagcatcctgtccttgcaggcttctgaattcccttctgagttaatgtcaaatgacagcaaagcactgtgtggctgaataagcggtg

SEQ ID NO: 814 - DNA, 251 bp, Homo sapiens
ccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccagga

SEQ ID NO: 815 - DNA, 410 bp, Homo sapiens; identical to SEQ ID NO: 235
  misc_feature 302, 303, 309: n = A,T,C or G

SEQ ID NO: 816 - DNA, 501 bp, Homo sapiens; identical to SEQ ID NO: 234
  misc_feature 56, 431: n = A,T,C or G

SEQ ID NO: 817 - DNA, 418 bp, Homo sapiens
  misc_feature 242, 287, 290, 330, 335, 398, 409, 414: n = A,T,C or G
cttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtantgacaacaggaggacaatcatctgctaaacttagtgttgacttgnaancctctgaagattttgacacctctgactgatcagactgtanatctnggaaaagaatctgctgagtgtgaaatctctgaaaacataccggaaatggactaaaatggccanccgttagagantgcgnctaa

SEQ ID NO: 818 - DNA, 237 bp, Homo sapiens
tgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatact

SEQ ID NO: 819 - DNA, 154 bp, Homo sapiens
  misc_feature 45: n = A,T,C or G
gtgctcacagtcatcaattatagacccacaacatgcgccctgaanacagaatgttccatatcagagctgtgatcttgagagccctctccttggctttcctgctgagtctccgaggagctggggccatcaaggcggaccatgtgtcaacttatgc

SEQ ID NO: 820 - DNA, 426 bp, Homo sapiens; identical to SEQ ID NO: 342
  misc_feature 222, 263, 339: n = A,T,C or G

SEQ ID NO: 821 - DNA, 252 bp, Homo sapiens
  misc_feature 67, 68, 237, 250: n = A,T,C or G
aacccaaggacacgcatttggtggacccaaagactgatccgtcggacagccagacggggttagcggnnattgcgcaggaataaggaagcgacctgcaaccgacgattcttctactcaaaacaaaagagccaacagaacagaagaaaatgtttcagacggttccccaaatgccggttctgtgggagcagacgcccaagaagcctggccttcagaaggacgtcaaacgtaaacagctcnaattaaggaatangt

SEQ ID NO: 822 - DNA, 368 bp, Homo sapiens
acttatagttactattttatctacaacgaacatgaattatttgtaagtttaaaacaaaaaaaaaagtaagaaaaaattcaaatagcacaagacttcatatccaagaaatcggtactctttcactcaagataattcagttacctagaggagcagaatcgatttttttccaagggttgaggtatgtttttttttctttccagtcagaatactcctgacagctgtcactgggttggtcccatggcaattctccagcgagcattgcagtaagtactattccacaggaccaaacatcaactggttctgcatgaaattctcttctcttcagaagttctggagcaacatatggtaaagtaccacacatcttgttc

SEQ ID NO: 823 - DNA, 558 bp, Homo sapiens
tgctggatgagctgaccctgggcagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcatagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgttgaggagcagctggcccagcttcgctgcgagatggagcagcagaaccaggaatacaaaatcctgctggatgtgaagacgcggctggagc

SEQ ID NO: 824 - DNA, 503 bp, Homo sapiens
tggtacgcctgcaggtaccggtccggaattcggctcgagtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctc

SEQ ID NO: 825 - DNA, 126 bp, Homo sapiens
aacaagatcgaacaggccatggatctggtgaagaatcatctgatgtatgctgtgagagaggaggtggagatcctgaaggagcagatccgagagctggtggagaagaactcccagctagagcgtgag

SEQ ID NO: 826 - DNA, 260 bp, Homo sapiens
cttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaagg

SEQ ID NO: 827 - DNA, 480 bp, Homo sapiens
  misc_feature 355, 393, 433: n = A,T,C or G
gagaagggagtagacaactgttcctgagggaaatctgggaagggttcatggagctgattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccagggcgaggaatatttcttacatctcctnttgcaattcccaggataaatgggaaggaaggtcctgtnttaaaggttcaaagtctttgtggaggaccaacaattaggntgttatggaaaactatagggtgtttcatgattcgtgtttttcgatgt

SEQ ID NO: 828 - DNA, 350 bp, Homo sapiens
  misc_feature 62, 73, 130, 306, 313, 322: n = A,T,C or G
gtggtggtggctgacttcgggctggcgcgtctcatggtggacgagaagactcagcctgaggnctgcggacctncaagaagccagaccgcaagaagcgctacaccgtggtgggcaacccctactggatggnacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctgggaccgctactgccccccaaacttnccccccnagcttcttnccccattcaccgtgcgttgttgcgattc

SEQ ID NO: 829 - DNA, 448 bp, Homo sapiens
  misc_feature 51, 324, 355: n = A,T,C or G
gacaagacgggcaccaggatcaagctcatcgactttggtctggccaggagntcggagaatgcggggtctctgaaggtcctctttggcaccccagaatttgtggctcctgaagtgatcaactatgagcccatcggctacgcacagacatgtggagcatcggggtcatctgctacatcctagtcagtggcctttcccccttcatgggagacaacgataacgaaaccttggccaacgttacctcagccacctgggacttcgaccacgaggcattcgatgagatctccgacgatgccaaggatttcatcagcaatctgctgaagaaanatatgaaaaacccgccttggactgcacgcantgcttttcaagcatccatggcttaatgaaagatacccaagaacatggagggccaagaaactctcccaaggaccggatgaagaagtacatggca

SEQ ID NO: 830 - DNA, 274 bp, Homo sapiens
tatttgatgttttacctgctcttctgagatactataatgtgttaaaagtcttacaagggaagatagtttttttcttttaattattaaaaaccaaaataaaacatcttttgagaaaggaatgtattgatgctggcaggtagaaaggaagctttgaaagaagcacagtaattttgctgaattctggccctgtatcatacaggcctaggactttcccccacttcctcaaatcaggataggagaagctattttttaactcctactgaaacaagaacct

SEQ ID NO: 831 - DNA, 294 bp, Homo sapiens
  misc_feature 90: n = A,T,C or G
tgcaacacactccagcctggctgcaacagcgtttgctatgaccaattcttccccatctcccatgtgcggctgtggtccctgcagctcatnctagtttccaccccagctctcctcgtggccatgcacgtggctcaccagcaacacatagagaagaaaatgctacggcttgagggccatggggaccccctacacctggaggagggagttagggagagagaagcaggcagataagttggagcaggggttggtcaaggccacctctgcctctagtccccaaggcctctctctgcctga

SEQ ID NO: 832 - DNA, 238 bp, Homo sapiens
  misc_feature 225: n = A,T,C or G
ccttccccgtcggcctgtactcgctcgagagcatcagcttggcggagaacacccaagatgtgcgggacgacgacatctttatcatcacctaccccaagtcaggcacgacctggatgatcgagatcatctgcttaatcctgaaggaaggggatccatcctggatccgctccgtgcccatctgggagcgggcaccctggtgtgagaccattgtgggtgccttcagcntcccggacaagta

SEQ ID NO: 833 - DNA, 289 bp, Homo sapiens
ggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacg

SEQ ID NO: 834 - DNA, 204 bp, Homo sapiens
cagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagata

SEQ ID NO: 835 - DNA, 258 bp, Homo sapiens
  misc_feature 174: n = A,T,C or G
tgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagangaaccagggcctggtgctgccctacacctacctagaccctcccctcatcgagaacagcgtctccatctaaatcccaggggaaca

SEQ ID NO: 836 - DNA, 228 bp, Homo sapiens
cctgactgcttgttcgtctcactggtgtgagctccagcatcccctttgctcgaaatggaccccaactgctcttgcgccactggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggat

SEQ ID NO: 837 - DNA, 235 bp, Homo sapiens
agcagcttcaggaggttgcactatcttttgactgtgcccacacccttcacaccttgtaaatagtccctttcttaaactctccttaaattacccagtttgggggtgctatctgtttcctgctgggatcctgatggctgtgttgcccaaacctaaatgtcagtcatgcttgcagttacagctgtgttattttcctgtagtactgatttccctcttttattaaaagttctgtggtggc

SEQ ID NO: 838 - DNA, 73 bp, Homo sapiens
  misc_feature 67: n = A,T,C or G
atttatttaaaggctaaaatttgtttttttattctttgcacaattgtttcattgtttgacgacttanatgcca

SEQ ID NO: 839 - DNA, 260 bp, Homo sapiens; identical to SEQ ID NO: 302
  misc_feature 89, 91, 108, 183, 188, 246: n = A,T,C or G

SEQ ID NO: 840 - DNA, 409 bp, Homo sapiens
  misc_feature 11, 363, 386, 394: n = A,T,C or G
actgcaatganaattcagagtctttaatatgcaaatgttaagaaaaggatacagtatgccacatttcccaaacttatttgtccatagacacttctatttacagaactgtgttaatgtctcttgaaacaatggtcatagaacagtttgggttaaagctatttaaaaatgaacaggctgtcttctaaaggagtagggtcaggttcacatcaagatatctggaaaaactggttggtctggctgccgctcttatatttctgaaatgcttgtcattaaaactgaagtatataaagtttggggcacttaggagcaatttctcttacctgttaacagtaaccattatctgttaatattaacagggtgccngttaacctggaccattgttacgnatttaacnttaaccggtatgggg

SEQ ID NO: 841 - DNA, 548 bp, Homo sapiens
  misc_feature 231: n = A,T,C or G
ttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcgnctgaatcctgacaaccagtaccttaaagtcctcctggctctgaagcttcataagatgcgtgaagaaggtgaagaggaaggtgaaggagagaagtttagttgaagaagccttggagaaagccccaggttgtaacagatgtacttcgcagtgcagccaagttttatcgaagaaaagatgagccagacaaagcgattgaactgcttaaaaaggctttagaatacataccaaacaatgcctacctgcattgccaattggggtgctgctataggcaaagtcttccaagtaatgaatcttagggagaatggaatgtatgggaa

SEQ ID NO: 842 - DNA, 601 bp, Homo sapiens
  misc_feature 518, 536, 566, 579, 582, 589: n = A,T,C or G
gcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggcaacgtatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatgggggaaagacaatcatttgaatacaaaaccaataagccatcacgcctgcccttccttgatattgcacctttggacatcggtggtgctgaccaggaattcttttgtggacattggcccagtctggtttccaattaatggactccatcttaatttaaaaagaangaatttgaaaaactttcnctttgccattcttctcctcctttttactgnagctgatcctccnttntctggantctcttgcttaa

SEQ ID NO: 843 - DNA, 443 bp, Homo sapiens
  misc_feature 215: n = A,T,C or G
atgatgccaatgtaaaatggtttaagaatggtgaagagattatccctggtccaaaatcaagataccgaattagagttgagggtaaaaaaacacatcttgatcatagagggagcaacaaaggctgatgctgcagaatattcagtaatgacaacaggaggacaatcatctgctaaacttagtgttgacttgaaacctctgaagattttgacacctcntgacctgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtattttgcacctgatgcctacaatgttactctgcctgc

SEQ ID NO: 844 - DNA, 518 bp, Homo sapiens
tagtggatcccccgggctgcaggaattcggcacgaggttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaat

SEQ ID NO: 845 - DNA, 517 bp, Homo sapiens
tggtacgcctgcaggtaccggtccggaattcccgggtcgacccacgcgtccggtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattc

SEQ ID NO: 846 - DNA, 280 bp, Homo sapiens
  misc_feature 120, 192, 255: n = A,T,C or G
gaaaataatgcacatatggtgttcaaatttgaacctttctcatggatttttgtggtgtgggccaatatggtgttcacattatataattcctgctgtggcaagtaaagcacactttttttntctcctaaaatgtttttccctgtgtatcctattatggatactggttttgttaattatgattctttattttcnctcctttttttaggatatagcagtaatgctattactgaaatgaatttcctttttctgaaatgnaatcattgatgcttgaatgatagaa

SEQ ID NO: 847 - DNA, 457 bp, Homo sapiens
  misc_feature 341, 368, 396, 432, 437: n = A,T,C or G
aaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattgggaccacagttaagatccagcctctcttcacctctttcagggctgagtgcatgagtcttgcacctncagggaaggctctgttgcagtacttancccctccgtcttgtttccttccaaggtnttggggggttggggcagtgtttaaggggcttccttnggagnccaaagggacaagcattggt

SEQ ID NO: 848 - DNA, 691 bp, Homo sapiens
ctcactatttggaatttggccctcgaggccaagaattcggcacgaggaaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacac

SEQ ID NO: 849 - DNA, 491 bp, Homo sapiens
tggtacgcctgcaggtaccggtccggaattcccgggtcgacccacgcgtccgtggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgaaaa

SEQ ID NO: 850 - DNA, 483 bp, Homo sapiens
tggtacgcctgcaggtaccggtccggaattcccgggtcgacccacgcgtccggtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaaataaatgtttggggggtgttctgttttctccaaaaaaaaaaaaaaaaaaaaaa

SEQ ID NO: 851 - DNA, 376 bp, Homo sapiens
tggatcccccgggctgcaggaattcggcacgagcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatgctaggctgggcatggtgactcacgcctgtaatcccccagcaatttgggaggcaaaggtgggagaatcgcgtgggcccgggagttccagaccaggctgggtcacatgacaaagccccatctctacaaaaaaaaaaaaaaaaacccggggggggggc

SEQ ID NO: 852 - DNA, 271 bp, Homo sapiens
  misc_feature 114: n = A,T,C or G
gacatcaccctacccaggcggtgggtctccaccacagccactttgagtctgtggtccctggagggtggcttctcctgactggcaggatgaccttagccaagatattcctctgtnccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaa

SEQ ID NO: 853 - DNA, 261 bp, Homo sapiens
  misc_feature 48, 55, 150, 169, 213, 222, 239, 257: n = A,T,C or G
cggacggtggggattaagttcaatgtatgggacaaagccggccagggngaaattnggtggacttaggagatggctattatattcaaggccagtgtgccatcataatgttgaagtaacatcgagagttacttacaagaatttgcctaactngcatagagatcttgtacgngtgtgtgaaaacatccccattgtgttgtgtggcaacaaagtggntattaaggncagggaagtgaaggcgnaatccttgtctttccccngaag

SEQ ID NO: 854 - DNA, 215 bp, Homo sapiens
  misc_feature 63, 75: n = A,T,C or G
ctttttcacaaggctagttcgaaaacatgataagttgaaaaaagaggcagttgagaggtttgntgagaaattgancctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatct

SEQ ID NO: 855 - DNA, 407 bp, Homo sapiens
tggtacgcctgcaggtaccggtccggaattcccgggtcgacccacgcgtccggaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccgg

SEQ ID NO: 856 - DNA, 286 bp, Homo sapiens
gaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggatccgggtgaagcctgttcagccgtctgtgtcatgtggccatcttgagtctactctgtcgctcttgtgccctagcaccccgagaacc

SEQ ID NO: 857 - DNA, 321 bp, Homo sapiens
  misc_feature 28, 145, 156, 185, 251, 264, 287, 310: n = A,T,C or G
ctggctcaccccacatggccgccgcttnctgcgggcctgccaggtggcccatgaccatacagaccaggtcatcagggagcggaaggcagccctgcaggatgagaaggtgcggaagaagatccagaaccggaggcaactgggcttnctgggacaatnttctgggtgcccgggatgaagatgacaanaaacttttaagatgcagaccttcgggctgaagtggacacattcatgtttgaaggccatgacaacancaccagtggtatnttctggtttctctactgcatggncctgtaccctgagcaacagcatngttgtagagag

SEQ ID NO: 858 - DNA, 264 bp, Homo sapiens
  misc_feature 4, 45, 116, 151, 177, 184: n = A,T,C or G
ctgnacccataatggccgatacttgccggtaaactcctccctgcngacctcagactgcagcgagcgctgttcctgttcctcaagctctggcctgacatgccaggccgctggctgcncaccaggccgtgtatgtgaggtcaaggctgaagcncggaactgctgggccacccgtggtcnctgtgtnctgtctgtgggtgccaacctcaccacctttgatggggcccgtggtgccaccacctctcctggtgtctatgagctctcttc

SEQ ID NO: 859 - DNA, 199 bp, Homo sapiens
cagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatc

SEQ ID NO: 860 - DNA, 535 bp, Homo sapiens
gccagagtgatgtctggagctacgtggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctc

SEQ ID NO: 861 - DNA, 683 bp, Homo sapiens
  misc_feature 8, 469, 576, 629, 639, 657, 668: n = A,T,C or G
caggtatnttttgtttagcccttcattataaatgggcaggaaattgtttatcaacctagccagtttattactagtgaccttgacttcagtatcttgagcattcttttatatttttcttttattatcctgagtctgtaactaaacaattttgtcttcaaatttttatccaatatccattgcaccacaccaaatcaagcttcttgattttcaaaaataaaaagggggaaatacttacaacttgtacatatatattcacagtttttatttataaaaaaaatttacagtacttatggagagccagcagaagacatcagagcactcacttcttcccatctttgttaaggttagcgaattacccatggacactgttaggtgaggctcattcggcagccctgaaaacaaacctggtcacactgtctttaccctctcccttcagataaagcacttcggattaatctattggatctgncccaggttttcaaggtcatgcggaatacttaaaaaggggtacaccatctgggatctggaccttgggctaatataagccatggtttcccccctattccaatggtttcntttttttggggtgaacattgggaaaccaggggggtgggctttattactgggtnaattaaaccnaatgggaatggccaggcnttaaaacaggngcctggtacccttcc

SEQ ID NO: 862 - DNA, 409 bp, Homo sapiens
tggtacgcctgcaggtaccggtccggaattcccgggtcgacccacgcgtccgaaaatgtgcaattttcatacagcatcccagtgttgatcatggaggttaatgattctttattgttagggacctatcttgtaattccagagttatttatgttttctacagttgaagaggaaaaataccgcttcttattgcctccttttcaggatttcttctggcttcttgagtagctggagtatttttgagagactcctacaggccctgcggggtggcacatgcctgtaatcctagctacttaggaggctgaggtgggagaattgcttaaacccgggaggcagaggttgcagtgagccgagatcgcatcactgcactccagcctgggcgacagagcaagactctgtctcgaaaaaaaaa

SEQ ID NO: 863 - DNA, 493 bp, Homo sapiens
tggtacgcctgcaggtaccggtccggaattcccgggtcgacccacgcgtccgattaacaccacccacaagcacaaaaaattaggatgaaaatgttcttcaagaatatggtggaataattgtagcctattgaaaattcataaatgaaaattggagtattgtagacagcattcttgaatcacatgtttgtttctgtgtgtaatactgatgactgtcttaaaatttctaacttccaaataaatcatactccactggattataagggcttcaagtgtgggggctgtctcactttcataaggccagtgtcttgcgcattgtctgaaacacagtagatgttttgataaacgtttgggccaggcttgggggcttacacctgtaatcccaacactttaggaggctgaggctggaggatggcttgtgcccaagagtttgagaccagcctgggtaacatagtgagaccctatctctacaaaaaaaaattaaaaattaaaaatt

SEQ ID NO: 864 - DNA, 264 bp, Homo sapiens
cttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacag

SEQ ID NO: 865 - DNA, 288 bp, Homo sapiens
  misc_feature 19: n = A,T,C or G
tgccggcggccctcacagnaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcactt

SEQ ID NO: 866 - DNA, 572 bp, Homo sapiens
  misc_feature 14, 15, 17, 24, 38, 341, 388, 462, 475, 481, 492, 549, 565: n = A,T,C or G
gaaagtcggctagnntntgcaaanttgtgggctgagantctcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatccgaaaatgaagatttcatcaaagactgcgttcgaatccataacaagttcccgatcagaggtgaaaccaacaagccaagtgatatgctatacatgacttgggacccagcactagcccaaattgcaaaagcatgggccagcaattnccagttttcacataatacacggctgaaagccacccccacaagctggnaccccaaactttcactttcactggggagagaacatcttgggacttgggtctgttgcccattttttctggggtcnttccggcattcanaaactnggtatgacganaatccaggactattgacttcaagactccggatatgcaaaaaatctgtggggcactanactcagggtgtttttnggcagat

SEQ ID NO: 867 - DNA, 350 bp, Homo sapiens
  misc_feature 50, 98, 125, 322: n = A,T,C or G
aaggatgaaattggaaagggctcctatggtgtcgtcaagttggcctacantgaaaatgacaatacctactatgcaatgaaggtgctgtccaaaaagangctgatccggcagccgctttccacgtngccctccaccccgaggcacccggccagctcctggaggctgcatccagcccaggggccccattggagcaggtgtaccaggaaattgccatcctcaagaagctggaccaccccaatgtggtgaagctggtggaggtcctggatgaccccaatgaggaccatctgtacatggtgttccgaactggtcaaccaagggcccntgatggaaagtgcccaccctcaaaccac

SEQ ID NO: 868 - DNA, 562 bp, Homo sapiens
acaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgat

SEQ ID NO: 869 - DNA, 671 bp, Homo sapiens
gaatttggccctcgaggccaagaattcggcacgaggaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtg

SEQ ID NO: 870 - DNA, 573 bp, Homo sapiens
actgttgaccatgtagttttatttcatcagtactcccatttttaatggattcaggcagcaccccagagtacaggactgagttcctaggggtggcctgacccagcagctgtcttctgttccaggaggaaaaagctttttattaaaaaacagaaacgaaactttagaaaatatgaaaaatcagagggaggacagaggtcatttcataaaatcgttatttgaaaacagtgcagtgtgcaaataacactcagttgggaatcgggagaccggggactagtctaactggctcaaactagctgtgaccttaggcgtgtcattcaccacttggggatcatttcctcatctaaagcattcagcacagttaccctgtgaggcactttacaggtgcaaaatcttaaggtgcccccagtgtttgctatcaagtccattctgcggacatatttggtgtcatatcctttctgatgaacaccaggaaaagccaggaggaaatctcacgaatatatattaggctagtccagcatctcgtgccatcctgtagaagatgcctctagctgcaatgagggtggctggagaatc

SEQ ID NO: 871 - DNA, 563 bp, Homo sapiens
ccaagaattcggcacgaggtttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactc

SEQ ID NO: 872 - DNA, 503 bp, Homo sapiens; identical to SEQ ID NO: 338

SEQ ID NO: 873 - DNA, 586 bp, Homo sapiens
gatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaaga

SEQ ID NO: 874 - DNA, 238 bp, Homo sapiens
  misc_feature 159, 227: n = A,T,C or G
agcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaaganagccacattgtgccatcttcagctccagtggctttagcagtgactgtttgacataaaacatgtaaganttgcttgttgg

SEQ ID NO: 875 - DNA, 238 bp, Homo sapiens
  misc_feature 169, 183, 187, 188, 201, 212, 214, 215, 231, 233, 237: n = A,T,C or G
cagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccanataggacacgaggntgcnnaggctggggtccnaggtggggccnannaaggaggtggggtgtngncccnc

SEQ ID NO: 876 - DNA, 225 bp, Homo sapiens
  misc_feature 8, 23, 28, 47, 50, 85, 108, 110, 112, 121, 122, 133, 152,157, 161, 172, 182, 190, 216: n = A,T,C or G
agcggttnctggggaggtacatntacanccgggaggagtacgcgcgnttngacagcgacgtgggggagttccgggcggtgacggngctgggcggcctgtgcggagtantngnacagccagnnggacatctggnggagaagcgggcagtgccngacanggtntgcaggcacanctaggagctngacgaggncgtgaccctgcagcggcgagttcagnctaaggtgg

SEQ ID NO: 877 - DNA, 283 bp, Homo sapiens
  misc_feature 96: n = A,T,C or G
cgacttcttttgaaatgtgaacgtccttccttgactgtctagccactccctcccagaaaaactggctctgattggaatttctggcctcctaaggcnccccaccccgaaatcagcccccagccttgtttctgatgacagtgttatcccaagaccctgccccctgccagccgaccctcctggccttcctcgttgggccgctctgatttcaggcagcaggggtgctgtgatgcggtcctgctggagtgatttatactgtgaaatgagttggcagattgtggggtgc

SEQ ID NO: 878 - DNA, 457 bp, Homo sapiens
  misc_feature 70, 358, 385, 399, 417, 423, 428, 433, 456: n = A,T,C or G
aatttgaagtagatagaaaccgacctggattactccggtctgaactcagatcacagtaggactttaatcngttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattcggatcaattgagtatagtagttcgctttgactggtgaagtctttagcatgtactgctcggaggttgggttctgctccgaggtcgccccaaccgaaatttttaatgcaggtttggtagttttagggacctgtggggttttgntagggtactgttttgcattaagtaaanttaaaggctcccanaggggtccttccccgtcnttggcnggtgntccangccccggccttctttcgcggggnt

SEQ ID NO: 879 - DNA, 567 bp, Homo sapiens
tggtacgcctgcaggtaccggtccggaattcccgggtcgacccacgcgtccggggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaagctgtgcttgatgtatttgaggagggcacagaagcatctgctgccacagcagtcaaaatcaccctcctttctgcattagtggag

SEQ ID NO: 880 - DNA, 343 bp, Homo sapiens
gaccagtatgagaagatggcagagaagaaccgcaaggatgccgaggaatggttcttcaccaagacagaggagctgaaccgcgaggtggccaccaacagcgagctggtgcagagcggcaagagcgagatctctgagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctgg

SEQ ID NO: 881 - DNA, 196 bp, Homo sapiens
  misc_feature 86, 135: n = A,T,C or G
caaacttcttcgactcagattcagaaatgatctaaacacgaggaaacattattcattggaaaagtgcatggtgtgtattttagggnttatgagcttctttcaagggctaaggctgcagagatatttcctccaggnatcgtgtttcaattgtaaccaagaaatttccatttgtgcttcatgaaaaaaaacttctggt

SEQ ID NO: 882 - DNA, 148 bp, Homo sapiens
ggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccaca

SEQ ID NO: 883 - DNA, 507 bp, Homo sapiens
  misc_feature 28, 393, 431, 495: n = A,T,C or G
ttttttttttttttgaccagaaaaagtntttattcatcaagtctttaaagatacaaaaacacgtgtcttctgtggagctctgagaacaggactccagcaaagcacttttcagccttgtggtcttcaagcatttccaagatctttgctgcaaggagcattgtactcagcaattgcaaactcatccgtctcgtagtaatcatagactttcactatgggctggtttcagatctcttactgggacatcttgcagaaccgtgaagaacaagctcagtgtctgatttgacaccttatcaaggtaaatcaagacatgggttgctgctgacttctgtccggctcacatggttagatctttcaaggcattttcactgttgggctttcagggggaatggaagncaggaggaccatttttcacatccaaacggttcgccatnttgggagggcagaggggcttccccgttgtaaccgaacacttaggggagattttgggaagccggntttgggctttgg

SEQ ID NO: 884 - DNA, 549 bp, Homo sapiens
cggcacgaggcattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagagattcaagaatctcttagtaagatgagatacgatgagatcacagctacatatttgttattggggagaaatcttcagaggt

SEQ ID NO: 885 - DNA, 388 bp, Homo sapiens
gcaggaggtgctgtgggttggagccgtgggctgtggagggtttgtgtatgatgagaagccctgtacagtcttctcaagaaataccctgagccagtctctgagacgcttcggtaaaaaatgtccctggatggaatcaagattttaaattcaaataaagcctaatatcatgttgtgtccacattatttagtcttttttttttttttttgaaaagggattctaattttgccccccaggtggggggccaggggggtaatttaatttaatggaaacctccccctccggggttaacccctttttcttgcttaaccctccgaagtggtgggaactaagggtccccccccccttcccgggttaaattttggttttttttttaaaaaaaaagggggt

SEQ ID NO: 886 - DNA, 168 bp, Homo sapiens
  misc_feature 85, 128, 146: n = A,T,C or G
ggtaatgaaaccgtgaactttattgagaactttcaagcatcataacttgaagaagtatttctcaattcagtttatcgaaatactncagctttccagctggatctgggattatggtttcactaccaggnttccagccagcagggcanacttctccgtgtttgtcagtgt

SEQ ID NO: 887 - DNA, 580 bp, Homo sapiens
taccggtccggaattcccgggtcgacccacgcgtccggtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaagtgtgccgcgtggtacctctggtggcgggc

SEQ ID NO: 888 - DNA, 270 bp, Homo sapiens
  misc_feature 136: n = A,T,C or G
ccctgaccatctgcttccctgagtacacaggggccaacaaatatgatgaggcagccagctacatccagagtaagtttgaggacctgaataagcgcaaagacaccaaggagatctacacgcacttcacgtgcgccanccgacaaccaagaacgtgcagttcgtgtttgacgccgtcaccgatgtcatcatcaagaacaacctgaaggactgcggcctcttctgaggggcagcggggcctggcgggatgggccaccgccgactttgtacccc

SEQ ID NO: 889 - DNA, 250 bp, Homo sapiens
  misc_feature 15, 35, 39, 50, 55, 73, 77, 89, 91, 111, 126, 162, 189, 195,210, 219, 225: n = A,T,C or G
cccattcagtggaangaagtcagctccggaagcgncganctgtccttctncaagntcaagtgtgggccgcggnccgntgtgccgcagantngcggctttgggttctgcaanggcatggtcgtccanccgcagaaccccttgaggagcgggcctgctgggggntatcagaccctcggggagaacagcaanccctanggtggcccagagcanttgatgctncacaanagccccggaagtggcaacagtggaa

SEQ ID NO: 890 - DNA, 207 bp, Homo sapiens
  misc_feature 201: n = A,T,C or G
caatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaagggnataggg

SEQ ID NO: 891 - DNA, 151 bp, Homo sapiens
  misc_feature 56, 65, 71, 87, 91, 107, 133: n = A,T,C or G
ccaccactgatgccacccaggacctcggaccttggagcctgcggggtgcctcggancctccagcnccgggncggacctcctgctggntctngcccaccaaccaagtnttacaagccccagaatgctgcccggnctgccctgctgggcggac

SEQ ID NO: 892 - DNA, 232 bp, Homo sapiens
gagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggct

SEQ ID NO: 893 - DNA, 461 bp, Homo sapiens
ccaactttctgtttcagaggcagcagcagtgagctgcaattgcagccagccctttccccagccccactcccttctatgaactcctagccttcttcgcagacagcctagcatctggctaaagggcaccttgttagcaaacacaatttctatgaacggattacccatggactgaagctgttgttgccagcggctggaggaggggactccagacatgagtgttccatgagtgatgcagatgtggagtggaggtctcaggtgaggtgctgcagagccctgggtaacagaacgagtgagacagtaaggactaaactctagagatctttgcacaccttaactagcccgaggtccgtgtgacaagtccggtatgcactgcgggggaaatgcaccccaggcagaagccggcccttccaggcgtggcatcctggggcacctgccaggatgctcacagccctctcgtccac

SEQ ID NO: 894 - DNA, 629 bp, Homo sapiens
tttttcacactacaatagttaattttatttgttcaagagctcagattgcaagcattaaaccaagcataggctttgattctgtgagcccaaattcacatattgaagaagatcaaagcaaactgtgatccatgtacatggatgaaaactaaaggctcgagttaatcacattgtagtttttaaatttctacagcctagagctcactagtcacaggtcttttaggtccttctggatgtcccacagggtatctgcacttttcttgagctgagcaacctcatcatcctttagcttctggttgataacgctggttaatccccgggcattgaggatacatggaaggctcaggaagacttcattctcaatgccatacatcccctttaccattgttgacacgggatgaatcctggatagatttttcaacatggattcaataagatcagccacacttaatccaatagcccagttggtatatccttttagcttgatgacttcataggcactttcaaccaccatcttatgcacttccttccaattttcactatcatttgcagttcccatttctggattcattcctggagagaacacctgcccattacaccatccacacagccacactgagtcgcatgtcccc

SEQ ID NO: 895 - DNA, 543 bp, Homo sapiens
tcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgaca

SEQ ID NO: 896 - DNA, 214 bp, Homo sapiens
  misc_feature 137, 161: n = A,T,C or G
aaattttttaccatgttatattagtcttttaaccttatttatagtttttttgttataaaagttaagttttatgatgtaaacttaatctctttgattttataattcctggttttcccgacgtgcgtagaatgaccttncccacaaggtaataaaaatacctncatgattttgcttaaaacttttatgctttatattaaatctttgttacatcttg

SEQ ID NO: 897 - DNA, 273 bp, Homo sapiens
  misc_feature 25, 111, 162, 256: n = A,T,C or G
gggctccaggcagaagcacagcctncccgacctgccctacgactacggcgccctggaacctcacatcaacgcgcagatcatgcagctgcaccacagcaagcaccacgcggnctacgtgaacaacctgaacgtcaccgaggagaagtaccaggaggcgttggncaagggagatgttacagcccagatagctcttcagcctgcactgaagttcaatggtggtggtcatatcaatcatagcattttctggacaaacctnagccctaacggtggtgg

SEQ ID NO: 898 - DNA, 277 bp, Homo sapiens; identical to SEQ ID NO: 304
  misc_feature 66, 88, 99, 102, 103, 139, 144, 181, 196, 208, 255, 277: n = A,T,C or G

SEQ ID NO: 899 - DNA, 701 bp, Homo sapiens
gactcactatttggaatttggccctcgaggccaagaattcggcacgaggacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaacca

SEQ ID NO: 900 - DNA, 235 bp, Homo sapiens
ttcggtacgaggaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacag

SEQ ID NO: 901 - DNA, 459 bp, Homo sapiens
tggtacgcctgcaggtaccggtccggaattcccgggtcgacccacgcgtccgatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtgggaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcagataaaaaaaaaaaaaag

SEQ ID NO: 902 - DNA, 617 bp, Homo sapiens
aagctcggaattcggctcgagagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctcttcatagtacttgtaaagtgttttggctggaatattctgc

SEQ ID NO: 903 - DNA, 203 bp, Homo sapiens
aatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtccta

SEQ ID NO: 904 - DNA, 253 bp, Homo sapiens
  misc_feature 15, 63, 88, 89, 90, 91, 92, 93, 94, 95, 96, 97, 98, 99, 100,101, 102, 103, 104, 105: n = A,T,C or G
tgcaaattgtgactnttaccatgaggcccactgacagacaccctgtagggattgtgtcaggtnctcactaagtgacacagggttggcnnnnnnnnnnnnnnnnnngtcagttcacattttgagagcagttggtgtaggtgcacttgattttagaacgatgagtttaaaacatttgtgaaaacctctttccattcagaaaggtggaaaaagtttcctaaaataaaccattttgataaagcagcaaaatgctgca

SEQ ID NO: 905 - DNA, 272 bp, Homo sapiens
aaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaat

SEQ ID NO: 906 - DNA, 286 bp, Homo sapiens
  misc_feature 247: n = A,T,C or G
aggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagcttcatttnaaccaaaggagctccgatgtaaggggcaaggctgcccct

SEQ ID NO: 907 - DNA, 243 bp, Homo sapiens
  misc_feature 15, 26, 55, 68, 97, 102, 132, 136, 156, 169, 192, 205, 226: n = A,T,C or G
gcagtttcgtggctncctgggacagnctgagcttagctcagcgccggggctttancaaggacctacantgttggctgtgaggaatgcacagtgtttncctgnttattcattccctgcaaactgcagagtggnactnaatgcttgtggacggaccanttcttcaaggctntgaaaagggctttcagttccgtnaacttgctgcctnccttgggaggcaaggctttgnaactgggaaatcctgaa

SEQ ID NO: 908 - DNA, 256 bp, Homo sapiens; identical to SEQ ID NO: 58

SEQ ID NO: 909 - DNA, 386 bp, Homo sapiens
tagtggatcccccgggctgcaggaattcggcacgagttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattg

SEQ ID NO: 910 - DNA, 232 bp, Homo sapiens
gaagctgctggggtctctggccctgcaggaagaggaagaggaggcgagcacgggccccaggtgcccctgagccagcctccagaggatgagctggataggctgacgaagaagctggttcacaacatgaaccacccgcccagcggggagtactttggccagtgtggtggctgcggagaagatgtggttggggatggggctggggttgtggcccttgatcgcgtctttcacgtgg

SEQ ID NO: 911 - DNA, 155 bp, Homo sapiens
gcccagccaagcactgtcaggaatcctgtgaagcactccagctatgtgtgaagaagaggacagcactgccttggtgtgtgacaatggctctgggctctgtaagccggctttgctggggacgatgctcccagggctgttttcccatccattgtggg

SEQ ID NO: 912 - DNA, 435 bp, Homo sapiens
  misc_feature 65, 73, 382, 430: n = A,T,C or G
tttttttttttttttttttactgcaggatatctcagagtctttaatatgcaaatgttaagaaaanggatacangtatgccacatttcccaaatttatttgtccatagacacttctatttacagaactgtgttaatgtctcttgaaacaatggtcatagaacagtttgggttaaagctatttaaaaatgaacaggctgtcttctaaaggagtagggtcaggttcacatcaagatatctggaaaaactggttggtctggctgccgctcttatatttctgagatgcttgtcattaaaactgaagtatataaagtttggggcacttaggagcaatttctcttaccctgttaacaggtaaccattatctgttaatatttaacagggngccctggttaaccatggaaccattgttacggggatttaaccattaacnggtat

SEQ ID NO: 913 - DNA, 491 bp, Homo sapiens; identical to SEQ ID NO: 498
  misc_feature 24, 162, 165, 189, 192, 364, 423, 467: n = A,T,C or G

SEQ ID NO: 914 - DNA, 657 bp, Homo sapiens
ttttttttttagtgtcctctaattttattgatgcttcagttttcataaagtgcaataaacaacataaatagatgaaaaaagctttgaagatttatatacagttttgaggttaagataaattactgactatattcctttcagccttttaactctgtgaaagctgtaacgtacattaaaagcacattgaactaggttaaataatgatctttcccccttagatcaatctagtattaaggagtatataattatgcaagttcattctataacacgaggctagactaaaaggacaatttttgtgctacagactaaatccagatacggtcaggtgctgagcagtattcctggcttcaaaataggaggtatctgtttcatcatctggctgcgcgggatgaaaggcatagtctgatgctgcagattttcccagtccacatcactgaagagaggatgacgttttagctctttcattccagctctctttgtatcatcaatggttaaaagtatttctactgcactttgaggcattatcagataacttttcttcaccttctggccagggatatctcttttcagaatattctggaatacttgttgtggtgtttcatcattgaaagggggaattcctgttagaaattccaaccagcaaacttccagtggcca

SEQ ID NO: 915 - DNA, 532 bp, Homo sapiens
atttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactg

SEQ ID NO: 916 - DNA, 236 bp, Homo sapiens
  misc_feature 96: n = A,T,C or G
gtggctcaggtccccctgggcccggagtgctcgagagctgtcatgaagctggtctactgtgctcactgcctgggagtccccggcgccaggccctgncctgactattgccgaaatgtgctcaagggctgccttgccaaccagtccgacctggacgccgagtggaggaacctcctggactccatggtgctcatcaccgacaagttctggggtacatcgggtgtggagagtgtcatcgg

SEQ ID NO: 917 - DNA, 210 bp, Homo sapiens
  misc_feature 110, 178: n = A,T,C or G
attccggccctgatggtcacggcggagaaggacttcgtgctcgttcctcagatgtcccagcacatggaggactggattccccacctgaaaaggggacacattgaggactntgggcactggacacagatggacaagccaaccgaggtgaatcagatcctcattaagtggctggattctnatgcccggaacccaccggtggtctcaaagatc

SEQ ID NO: 918 - DNA, 84 bp, Homo sapiens
  misc_feature 4, 8, 21, 23, 25, 36, 48, 51, 75, 81: n = A,T,C or G
ctgnaggntacggcaagatanangnagtaaagcagntagatatgcggnccntccgctagttcacctaccgaggcntagacntcg

SEQ ID NO: 919 - DNA, 209 bp, Homo sapiens
catgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggccc

SEQ ID NO: 920 - DNA, 533 bp, Homo sapiens
gcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagc

SEQ ID NO: 921 - DNA, 491 bp, Homo sapiens
ggcggaggcggcggcggcccggcagccaacatggcggcggcggcggcggcgggcgcgggcccggagatggtccgcgggcaggtgttcgacgtggggccgtgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcagccttccaac

SEQ ID NO: 922 - DNA, 277 bp, Homo sapiens
  misc_feature 166, 276: n = A,T,C or G
gctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgncaagaaaggtttttgccaatccagaagactgtgtagcatttggcaaaggagaaaatgccaagaagtatcttcgaacagatgacagagtagaacgtgtacgcagagccccnc

SEQ ID NO: 923 - DNA, 368 bp, Homo sapiens
  misc_feature 107: n = A,T,C or G
aatgaaggtgctgtccaaaaagaagctgatccggcagccgcttttccacgtcgccctccaccccgaggcacccggccagctcctggaggctgcatccagcccagggncccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaacct

SEQ ID NO: 924 - DNA, 497 bp, Homo sapiens
ttggccctcgaggccaagaattcggcacgagggaaaggagccaatttatgaaattaaataaagtccacatagggagtgagaaattgtggctcacgcaccccaccctggctgggcccagcactgctggagcacagcgcaccaggcacccccactgtctcacccgtctcaagagggggcttaaataggccatgccccatcctggaggccgggggtcccggggcctagggcggacagaagtcggagaagtaggggtgctgcagggcctcttctgctgagatacgctggacagggttacacttcagaaggttctgcagcagatccctccctgtggcattgagtttgggcacgacgttcaccagggatgttgtggccgggtacatcggatagggcttatagtctggcagcttggtcatagagggccactgctcctcggtgggcgtccccagcagtcggaagatcctcttcaactggtcatcgacatcattgccgggaaaaag

SEQ ID NO: 925 - DNA, 236 bp, Homo sapiens
tattactaaaggtttatttacatagtgtttaaagcataataaaaaataaattacaatacaaaagtgctctttaggaaggagacactaaacaacaggcccatattaccccttgactatttagccaagacataagctacaaattttgccggaaaaactgtccatacatttttaactacttcttcattattcttatggaccatcatccaggacatctgtttgaagaaatatccagttat

SEQ ID NO: 926 - DNA, 232 bp, Homo sapiens
gaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctgggg

SEQ ID NO: 927 - DNA, 177 bp, Homo sapiens
  misc_feature 111, 112: n = A,T,C or G
ggagcgagtgggggccggcgcgcccgtctacatggctgcggtcctcgagtatctgaccgccgagatcctggagctggcgggcaacgcggctcgggacaacaagaagacgcnnatcatccctcgtcacctccagctggccatccgcaacgacgaggaactgaacaagctgctgggcaa

SEQ ID NO: 928 - DNA, 255 bp, Homo sapiens
  misc_feature 6: n = A,T,C or G
cttggnaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatat

SEQ ID NO: 929 - DNA, 360 bp, Homo sapiens
  misc_feature 4, 33, 149, 150, 189, 191, 194, 237, 281, 289, 303, 319,321, 330, 343: n = A,T,C or G
gcantgctgaacaccaagaagggccctccaggncagtggtacagccatgatgagctggccagatgacgtccctcctgaaggctggaaccgcacccgccatgtcatcatcctcatgactgatgggattgcacaacatggcggggacccanntactgtcattttttgatccgggacttgctatacattggnanggntcgcaaaaacccaagggaggattatctggatgtctatgtgttnggggtcgggcctttggtgaaccaagtgaacatcaatgctttggnttccaagnaagacagtgagcancatgtgttcaaaagtnangggtatggnaaacctgggaagntgttttaccaaatgatc

SEQ ID NO: 930 - DNA, 577 bp, Homo sapiens
ctgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgata

SEQ ID NO: 931 - DNA, 491 bp, Homo sapiens
  misc_feature 5, 116, 140, 147, 157, 158, 184, 187, 190, 206, 423, 446,463, 486: n = A,T,C or G
ccagntgggtggtgagatcaatgtggagatggacgctgccccaggcgtggacctgagccgcatcctcaacgagatgcgtgaccagtatgagaagatggcagagaagaaccgcaagnttgcccgaggattggtttcttcancaagacnagaggaactnnaccgcgagttggccaccaacagttanctngtncagagtggcaagagtnagatctcggagctccggcgcaccatgcaggccttggagatagagctgcagtcccagctcagcatgaaagcatccctggagggcaacctggcggagacagagaaccgctactgcttgcagcttgtcccagatccaggggctgatttggcagcgtggaggagcagcttggcccagcttcgctgcgagattggagcagcagaaccagggattacaaaatncctgctggaatgttgaagacgcngctggagcaggagattnccacctaccgccgcctgcttganggaga

SEQ ID NO: 932 - DNA, 88 bp, Homo sapiens
  misc_feature 61: n = A,T,C or G
cctgtcagccatccgagaacttgcccgggaagtcgatcctgcttatatcaagattgaggangtcattgggacaggctcttttggagaa

SEQ ID NO: 933 - DNA, 346 bp, Homo sapiens
  misc_feature 38, 41, 48, 333: n = A,T,C or G
gaagatgatgaagatgatgatgatgaagatgatgaggnggnggaagangaggaggaggaagagcctgtcaaagaagcacctggaaaacgaaagaaggaaatggccaaacagaaagcagctcctgaagccaagaaacagaaagtggaaggcacagaacccgactacggctttcaatctctttgttggaaaccctaaactttaacaaatctgctcctgaattaaaaactggtatcagccgatgtttttgctaaaaatgatcttgcctgttgtggatgtcagaattggtatgactaggaaatttgggtttatgtggatttttggaatcctgcctgnaagaccctggaag

SEQ ID NO: 934 - DNA, 466 bp, Homo sapiens
  misc_feature 466: n = A,T,C or G
tcctgcgcggttgttctctggagcagcgttcttttatctccgtccgccttctctcctacctaagtgcgtgccgcacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagattgaagn

SEQ ID NO: 935 - DNA, 518 bp, Homo sapiens
tggtacgcctgcaggtaccggtccggaattcccgggtcgacccacgcgtccggaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatg

SEQ ID NO: 936 - DNA, 316 bp, Homo sapiens
  misc_feature 17, 33, 53, 60, 160, 195, 232, 237, 263, 285, 312, 313: n = A,T,C or G
gtggcctttgaccatgnagacccatccattttnacagtattgactgctaagtntgtccgncctggagtggccattgctgattttgtcatcttcccacctcgatggggggttgctgataagaccttcagggctccttattaccataggaactgcatgagtngggttaatggggcttatccgaggtcactatgaggnaaagcaaggtgggttctgccagggggagggagtctanacagnacaatgaccccccatggacctgatgntgactgctttgagaagggcagnaaggtcaagctggcaactgagaggttnncgt

SEQ ID NO: 937 - DNA, 275 bp, Homo sapiens
  misc_feature 52, 80: n = A,T,C or G
gacccagctgctcaactcgctctgcacagcagtcaaagccatctcttcggcngtgcgcaaggcgggcatcgcgcacctcnatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatg

SEQ ID NO: 938 - DNA, 496 bp, Homo sapiens
ccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagaggcgtatttggatatgagtatcctttgcttatctttgtagtactgaaaatttgccgaagtaactggctgtgcagaatgtaatagaagcttttcttattcttttattcttaagatcagtatctttttacagtattctttctacatgatcctttttt

SEQ ID NO: 939 - DNA, 622 bp, Homo sapiens
tgaaatatcatgtttatttggtggggatggtacagccagagtctaatgctattcctgaaggttacttctcagattagggaacctgggaatttgaagcgctacgaggccagccctggggcaagaactggaagggtttataggccccctgaataaaggcaatggcacttgatcctcaacaccagacatctaaggtacaactggaaatgactcattttggacagaaagggtttagagtaaagagctggactaaccaggagagaagtctagttggttccctacaggtgcactggaaacactgccatcagggaccttctgggatctggggagcactgctgccaattattaacagcattcagtgccagtagagacctatcctgcctagacaccactgcatcgctggtaatctatctatgacccactgtcagttggtactgatgtcctgccagaaagctcatcaacagtagactagattctcagaaacgagaggattctgaaggtatgcacccgatgccagttgctgcctgagtctcgcgttttagtgaatcatgcagatgcagttaattatgggtagccatcgctctgatccttgtggtgtgttgagtgttaaaacaccagattatct

SEQ ID NO: 940 - DNA, 254 bp, Homo sapiens
tggatcccccgggctgcaggaattcggcacgagccggaacagagtcctcagggaaggccagtggggacaagacagaaaaagtcaccatctatcaacaccatcgacgtttgagtgaagaaaccacccataagagagatgcactaacaactggggatagggatggggtcagggggagcccaagatggtgatctgcccgagactcccagagggtattgccactcccacaatctcaggcctggtacccatcctctttc

SEQ ID NO: 941 - DNA, 254 bp, Homo sapiens
  misc_feature 10, 15, 250: n = A,T,C or G
cttctgtctnacctngttagaaaattcctcccagtcaggggtcgtccagtgcaggacgggggacccaagggtctcaagcctgcaagtccagaaggtgacaaacccaggagcactgggagttaagctttccttggggagggaagagccttgatgtccagcacacagcctggctataaagacacgaagcgacctacccactgtacagtccacttcacaggatcagctgaatcatgacctttaaaagttccgngttg

SEQ ID NO: 942 - DNA, 106 bp, Homo sapiens
cctccaccccctcgtctctagtggacatttgagatcagagagcaccacagggctggctttgtgccctaacccctgggatgcagcctgcctttccataaagtcacct

SEQ ID NO: 943 - DNA, 297 bp, Homo sapiens; identical to SEQ ID NO: 122
  misc_feature 261: n = A,T,C or G

SEQ ID NO: 944 - DNA, 266 bp, Homo sapiens
  misc_feature 25, 37, 169, 186, 225, 244, 252, 264: n = A,T,C or G
tcacttcatgactgttgctacaaangtctggagaaangtgggatgtggcaacaaatttctgagctacaagtttagcaactcggggagcagagtcacctgtgcaaaacagggcttctgcagaagtcaactgtgtgagtgtgataaggctgctgccacctgttttgctagnaacaagacggcctacantaaaaattccttggccatgcagaaagcatccctcacccntcctagaggccaggcaggngccttctntacccacccagngt

SEQ ID NO: 945 - DNA, 402 bp, Homo sapiens
tggatcccccgggctgcaggaattcggcacgaggtttcaccacattggtcaggctggtcttgaaatgctggcgtcaagtgatctgcctgcctccgcctcacaaagcactgggattacaggcatgaatctggccttacgtaatatattttcttaatggctgcataatatcacatcaaataggcatttttcaaacctctttccttattaaacatgtagactatatccattttttactaaaataaataacatttcagataatatctttgcactgataatgttgccaagccatttctaaagtgaccttatcaatttaattaccattggatgagggtgttgctttcatcgcaccattgtagattgtcttttttatttcaatttgcgtttatttataactggttgcaa

SEQ ID NO: 946 - DNA, 465 bp, Homo sapiens
tggtacgcctgcaggtaccggtccggaattcccgggtcgacccacgcgtccgccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggatcacttgcacctgggaagtggaggttatagtgagctgtga

SEQ ID NO: 947 - DNA, 263 bp, Homo sapiens
  misc_feature 129, 182, 220, 234: n = A,T,C or G
gcttatcagaaggcacctactaaggagttttatgcgtaaaactccaacttagtgtctctatttatgagatcactgaacttttcaaaataaagcttttgcatagaataatgaagatctttgttttttggnttcattaaagagccattctggcactttaatgataaaatcccattgtatttaanacatttcatgtatttctttagaacaacataaaattaanatttaacatctgcngtgttctgtgaatagcagtggcaaaatat

SEQ ID NO: 948 - DNA, 277 bp, Homo sapiens
  misc_feature 79: n = A,T,C or G
ggatcgtttgacgggacttcaggttctttctgaaatcgccgtgttactgttgcactgatgtccggagagacagtgacancctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcactta

SEQ ID NO: 949 - DNA, 243 bp, Homo sapiens
cctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaa

SEQ ID NO: 950 - DNA, 650 bp, Homo sapiens
  misc_feature 637: n = A,T,C or G
aagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcaggttagatataactgcaggattttcagaccactctctgatactatggaaaatttattgctgatcccaaagatggatgacctgtccgntcaactaccacac

SEQ ID NO: 951 - DNA, 499 bp, Homo sapiens
tttttttttaatctttcaatcttttatttaaatgccatgatccaggatggattttagatcttgttgaaagcagccacatccatggactgcacatagtcctcaaaagcagtgatctgctcctccagcatatctgttccaactttatcatcttcaactacacactgtatttgaagtttcttaattccgtatcccactggaactagtttagatgagccccagactaagccgtctgcttgaatgcttctgacgcactcctctaatttcgccatatctgtctcatcatcccaaggtttcacatctagtaagatgggagacttgggaacaagtgcagggtttttggctttccttgattcaaattgtggcagacgttcttcccttagcctccttggctcttcaatttccaccgcatcatcaggtccaagagggcaatgtactcatcatctttactatctggagctccaattccgtaatggtctttccaatcggaaggaccatattt

SEQ ID NO: 952 - DNA, 546 bp, Homo sapiens
ctttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggg

SEQ ID NO: 953 - DNA, 423 bp, Homo sapiens
gcggccgccaacttggacgctgcagaatggctcccgcaaagaagggtggcgagaagaaaaaggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaa

SEQ ID NO: 954 - DNA, 664 bp, Homo sapiens
ctcactatttggaatttggccctcgaggccaagaattcggcacgaggcacactgcagcagagcttgtagctggacagagtcaaaaagaagaaaatacggtttcaggctttcttgcagatatgaagtattcttggaatgcaataagtatgtattgaactgtactgtaaagtagctccaaaacttaattactctcctgttttaggggttatacatttggactgtgcattctccaagagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgtgatctct

SEQ ID NO: 955 - DNA, 346 bp, Homo sapiens
ggacggggccgtgtccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccgggcagcgcaccaggttcaaggcatttgttgctatcggggactacaatggccacggcggtctgggggtaagggctccaaggagggggggcgccgccatccgggggccatgag

SEQ ID NO: 956 - DNA, 450 bp, Homo sapiens
tacggctgcgagaagacgacagaagggtacggctgcgagaagacgacagaagggtacggctgcgagaagacgacagaagggtacggctgcgagaagacgacagaagggcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttttttt

SEQ ID NO: 957 - DNA, 465 bp, Homo sapiens
tacggctgcgagaagacgacagaagggtacggctgcgagaagacgacagaagggtacggctgcgagaagacgacagaagggtacggctgcgagaagacgacagaagggtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttt

SEQ ID NO: 958 - DNA, 522 bp, Homo sapiens
cggctgcgagaagacgacagaagggtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccatcctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctc

SEQ ID NO: 959 - DNA, 523 bp, Homo sapiens
tcaaaaggacaagaatccttcaagaaacaggaaaaaaactcctaaaacaccaaaaggacctagttctgtagaagacattaaagcaaaaatgcaagcaagtataggaagaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgccgtttagtttttaaagatggaactccaccctttgcttggttttaagtatgtatggaatgttatgataggacatagtagtagcggtggtcagacatggaaatggtggggagacaaaaatatacatgtgaaataaaac

SEQ ID NO: 960 - DNA, 381 bp, Homo sapiens
  misc_feature 347: n = A,T,C or G
gagtcagtctcagtcaggacacagcatggacatgggggtccccgctcagctcctggggctcctgctactctggctccgaggttccagatgtgacatccagatgacccagtctccctcctccctgtctgcatctgtgggagacagagtcatcatgacttgccggacaagtcactatataagcagttatttaaattgggatcagcagataccagggacagcccctaagctctgatctatgctgcaccaagttgcaaatgggggcccatcaaggtcaaggccgtgatcttggacaaattcactctcacaatagcagctgcaaccgagatttgcacctatactgcaccggntatagacataataatccgccaggcacgatgaaga

SEQ ID NO: 961 - DNA, 336 bp, Homo sapiens
ggagtcagtctcagtcaggacacagcatggacatgagggtccccgctcagctcctggggctcctgctactctggctccgaggtgccagatgtgacatccagatgacccagtctccatcgtccctgtctacatctgcaggagacagagtcaccatcacttgccgggcaagtcagagcattagcacctttgtaaactggtatcagcagaaaccagggaaagcccctaacctcctgatctatggtgcatccagtttgcaaagtggggtcccagcaaggttcagtggcagtggatctgggacagatttcactctcaccatcagcagtctgcaacctgaag

SEQ ID NO: 962 - DNA, 332 bp, Homo sapiens
ggctggcctggggggcaccgaccgctataaggccagtcggactgcgacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaatgagctgaaggagctgatccagaaggagctcaccattggctcgaagctgcaggatgctgaaattgctaggctgatggaagacttggaccggagcaaggaccaagaggtgaactttcatgg

SEQ ID NO: 963 - DNA, 347 bp, Homo sapiens
  misc_feature 85: n = A,T,C or G
cgcatcttcatccagcacaacggactcatcaagattggctctgtggctcctgacactatcaacaatcatgtgaagacttgtcgangaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttc

SEQ ID NO: 964 - DNA, 534 bp, Homo sapiens
ttcggcacgaggctccttctttggaaactggtgttcaagataaagaaatgctgaaaaaatatggaaaatcatttagaaaaatgatttcattgtgccttcaaaaagatccagaagaaagaccaacagcagcagaactattaaggcacagatttttccagaaagcaaagaataaagaatttcttcaagaaaaaacattgcagagagcaccaaccatttgtgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtgtccccgagtgaaagaatcaatatcaaattctgagctctttccaacaactgatcctgtgggtactttgctccaagttccagaacagatctctgctcatctacctcagccagctgggcagattgctacacagccaaactcaagtctctctcccacccaccgcagagccagcaaaaaca

SEQ ID NO: 965 - DNA, 344 bp, Homo sapiens
gctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaa

SEQ ID NO: 966 - DNA, 241 bp, Homo sapiens
gacgacagaagggtacggctgcgagaagacgacagaaggggctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactcccaaaggggacattggagaagaaccaagctgggtc

SEQ ID NO: 967 - DNA, 402 bp, Homo sapiens
accatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatacctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggattta

SEQ ID NO: 968 - DNA, 442 bp, Homo sapiens
ctctctgctctcgcggctgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgagcgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagattaatcagagtcggaggactaggcaaaggctccccttacagggctttgcttattaataaaataaatg

SEQ ID NO: 969 - DNA, 443 bp, Homo sapiens
acgacagaagggtacggctgcgagaagacgacagaagggtacggctgcgagaagacgacagaagggtacggctgcgagaagacgacagaaggggcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccgtgataattctttgtatataaaataaacattcgaaaaaaaaaaaaaaaaaaaaattgggggcctttttttccgtaaacccaaacttaaaaaaaaccttg

SEQ ID NO: 970 - DNA, 405 bp, Homo sapiens
gggggtctcaggaggcagcactctcgggacgtctccaccatggcctgggctctgctcctcctcagcctcctcactcagggcacaggatcctgggctcagtctgccctgactcagcctcgctcagtgtccgggtctcctggacaggcagtcaccatctcctgcactggaaccagcagtgatgttggtggttatcactatgtctcctggtaccaacaacacccaggcaaagcccccaaattcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacccatgtggtattcggc

SEQ ID NO: 971 - DNA, 519 bp, Homo sapiens
cggctgcgagaagacgacagaagggaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgct

SEQ ID NO: 972 - DNA, 555 bp, Homo sapiens
cggctgcgagaagacgacagaagggatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtcccccgcagtgaagtggacatgttgaaaattaggtctgaattcaagagaaagtacggcaagtccctgtactattatatccagcaagacactaagggcgactaccagaaagcgctgctgtacctgtgtggtgggatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacact

SEQ ID NO: 973 - DNA, 342 bp, Homo sapiens
aaggcgatcttttaagaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggg

SEQ ID NO: 974 - DNA, 337 bp, Homo sapiens
gagctgtgggctcagaagcagagttctggggtgtctccaccatggcctggacccctctctggctcactctcctcactctttgcataggttctgtggtttcttctgacctgactcaggaccctgctgtgtctgtggccttgggacagacagtcacgatcacatgccaaggagacagcctcaaaacctattatgcaagttggttccagcaggggccaggacaggcccctctacctgtcatctatgccaacaataagcggccctcagggatcccagaccgattctctggctccaggtcaggaaacacagcttccttgaccatcactggggctcaggcgga

SEQ ID NO: 975 - DNA, 345 bp, Homo sapiens
gctctcttcctcggcgctgcctacggagggggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagcggcttccggaaggtcctggtccacaacgtcaaggagctggaagtgctgctgatgtgcaacaaatcttactgtgcc

SEQ ID NO: 976 - DNA, 345 bp, Homo sapiens; identical to SEQ ID NO: 975

SEQ ID NO: 977 - DNA, 297 bp, Homo sapiens
acaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttagga

SEQ ID NO: 978 - DNA, 434 bp, Homo sapiens
aatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgctgtgaacctcacaggcaggctaaacaagtgtggggtgatcagccccagatttgacgtgcaactcaaagacctggaaaaatggcagaataatctgcttccatcccgccagtttggcttcattgtactgacaacctcacctggcatcatggaccatgaataagcacgacgaccacacacaggagggaaaatcctgggattctttttctagggatgtaatacatatatttacaaataaaatgcctcatggc

SEQ ID NO: 979 - DNA, 140 bp, Homo sapiens
gagaagacgacagaagggacggaggagggtgaggagacagagggcgaggaagaggaggattaggggagtccccgggggactgctcaatacagatacggtggacgcaaaaaaaaaaaaaaaaaaaaaaaaagtcgtatcga

SEQ ID NO: 980 - DNA, 634 bp, Homo sapiens
tttttaaagaagtaagcctttatttccttgttttgcaaataaaactggctaagttggttgctttttggtgattagtcaaagagaccaaatcccatatcctcgtccgactcctccgactcttccttggcttcaaccttagctggggctgcagcagcaccaggagcagctgtggtggcagcagccacaggggcagcagccacaaaggcagatggatcagccaagaaggccttgaccttttcagcaagtgggaaggtgtaatccgtctccacagacaaggccaggactcgtttgtacccgttgatgatagaatggggtactgatgcaacagttgggtagccaatctgcagacagacactggcaacattgcggacaccctccaggaagcgagaatgcagagtttcctctgtgatatcaagcacttcagggttgtagatgctgccattgtcgaacacctgctggatgaccagcccaaaggagaagggggagatgttgagcatgttcagcagcgtggcttcgctggctcccactttgtcttcagtcttgatcagctgcacatcactcatgatttcaatggtgcccctggagattgtagtggtgatacctaaagcctggaaaaagaggtcttctcgggccc

SEQ ID NO: 981 - DNA, 611 bp, Homo sapiens; identical to SEQ ID NO: 271

SEQ ID NO: 982 - DNA, 503 bp, Homo sapiens
aagggggctcagcatttggggacgctctcagctctcggcgcacggcccagcttccttcaaaatgtctactgttcacgaaatcctgtgcaagctcggcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaactgacgaggactctctcattgagatcatctgctccagaaccaaccaggagctgcaggaaattaacagagtctaca

SEQ ID NO: 983 - DNA, 207 bp, Homo sapiens
gctcttaccgccatcttggctcctgtggaggtctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgctt

SEQ ID NO: 984 - DNA, 359 bp, Homo sapiens
gagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaac

SEQ ID NO: 985 - DNA, 281 bp, Homo sapiens
gcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtggcaggcaataaaattttaagaattcttaagtctaagggacttgctcctgatcttcc

SEQ ID NO: 986 - DNA, 411 bp, Homo sapiens
ggggcttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaa

SEQ ID NO: 987 - DNA, 318 bp, Homo sapiens
gctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaagcttgagtgcgttgagcccaactgcagatctaagagaatgctggctattaaaagatgcaagcattttgaactgggaggagat

SEQ ID NO: 988 - DNA, 232 bp, Homo sapiens
gcggttccgggcgttaccatcgtccgtgcgcaccgcccggcgtccaggtgagtctcccatctgcagagacacggacgcgccggcccgcaattggcctgcggagcgcggtggacggtttggcgcccaccaagcgaacaatactttggatttttaatttctagatttggcaattcttcgctgaagtcatcatgagctttttccaactcctgatgaaaaggaaggaactcattcc

SEQ ID NO: 989 - DNA, 337 bp, Homo sapiens
  misc_feature 337: n = A,T,C or G
tacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttn

SEQ ID NO: 990 - DNA, 355 bp, Homo sapiens
aaaacctttgtatagcaactattgaagtttctaaagaagtattaaacctttgaggggaaaaggctaaggggagtgaaactttgaaaggcaacacaggctggataactcaacattaaagttaaaagcctggagctgaaagtaaagacagcagattaattattcgtgaaaaggccattaagttgttttaatcaaaaggataagtatcatgtggattatgagggtctgaaaagtcagagtgatgggtgataaatggtctaaaaagcaaggatgtgacaagcagaagaaagacgatgataaactctatgcacagcggaaggaatcattttctatatgttttataatcctggtacaagtc

SEQ ID NO: 991 - DNA, 618 bp, Homo sapiens
  misc_feature 100, 301, 422, 448, 466, 510, 576, 598, 613: n = A,T,C or G
cagagctttaggtatcaccactaaaatctccaggggcaccattgaaatcctgagtgatgtgcagctgatcaagactggagacaaagtgggagccagcgancacagctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctagattggctacccaactgttgcatcagtaccccanttctatcatcaacgggtacaaacgagtcctggccttgtctgtgggagacggattacaccttcccacttgctgaaaaggtcaaggccttcttggcttgatccatctgcctttgtggctgctncccctgtggctgctgcaccacagctnctcctgctgctgctgcancccagctaaggttgaagccaaggaagagtcggaggagtcggacnaggatatggggatttggtctctttgactaatcaccaaaaagcaaccaacttagccagttttatttncaaaacaaggaataaagggttnattctttaaaaaaanaaaaa

SEQ ID NO: 992 - DNA, 557 bp, Homo sapiens
gaatttggccctcgaggccaagaattcggcacgagggtgaagatgtgtgactttggcgtcaggggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctact

SEQ ID NO: 993 - DNA, 330 bp, Homo sapiens
gctctcgccaggcgtcctcgtggaagtgacatcggctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatg

SEQ ID NO: 994 - DNA, 154 bp, Homo sapiens
gagaagacgacagaagggacaaagagatctggacagaatcgccggacaggtggcaactgccaacaagaagcattagaacaaaccatgctgggttaataaattgcctcattccaaaaaaaaaaaaaaaaaaaaaaaaaaaaagtcgtatcgatgt

SEQ ID NO: 995 - DNA, 512 bp, Homo sapiens
gcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgtagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtg

SEQ ID NO: 996 - DNA, 402 bp, Homo sapiens
cggctgcgagaagacgacagaagggaagatggaggaagtggaagccatgctgctcccagagaccctgaagcggtggagagactctctggagttcagagagataggtgagctctacctgccaaagttttccatctcgagggactataacctgaacgacgacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtgcctacagacacc

SEQ ID NO: 997 - DNA, 510 bp, Homo sapiens
acagaaggggcttttttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgat

SEQ ID NO: 998 - DNA, 350 bp, Homo sapiens
ggcctctccgccccgcgtgcagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagta

SEQ ID NO: 999 - DNA, 580 bp, Homo sapiens
tttctcactgcctgtataatcaggtctttattcaaaagaagctgtccaaaatgatttgacctttatggaataatcaaatttaagagtttatgcagcaggcttcttctcctctgtagtaggtttcttctctgcaggcttcttttcaggggctggtttcttggtagctgctgccttttttcccaccagaggcttcttctgcttcttaacaccaacagcagccttctttcctttcttacctaccacaggcttcttgcctgcaaccgccgccttctcatctgatttggcttgtagtgccgctgctgcagcacgtgccttatccacccggagcttgtgattcctggcctggcgaagaatggtgttccggcgcatggtctttgcatatgggtttagcttcaacatgattctcaagtttttcagtgggttcttctttaggactctgcgatggatcttcttgcgtggtgctcgaagggctctttggatctctgggcttttcaagattctgctaagatctgtattaatcatctggtgcatgggaagattgtagttactcttgagggaagccgctttaacgcaagtgccg

SEQ ID NO: 1000 - DNA, 830 bp, Homo sapiens
  misc_feature 586, 595, 620, 664, 666, 678, 699, 704: n = A,T,C or G
ggagtgcggcggcggcgggacccggagcaggagcggcgggagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgngcttgcccnggccttcagcctggccaagaacagncagcccaaccgctacaccaaccgtgtggtgacactctggtaccngncccccgagctgntgcttcgggagcgggactacngcccncccattgacctgtggggtgcttggtgcatcatggcagagatgtggacccgcagccccatcatgcagggcaacaccgagcagcaccaacttcgcctcattaagtcagttttgggcttcatcacccct

SEQ ID NO: 1001 - DNA, 342 bp, Homo sapiens
ggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaaccctacagtctcccaggtggtccataaggctgtgcttgatgtatttgaggagggcacaga

SEQ ID NO: 1002 - DNA, 384 bp, Homo sapiens
tacggctgccagatgacaacagaaggggagctgtgggctcagaaacagagttctggggtgtgtccaccatggactggacccctctctggctcactctcctcactctttgcatagggtctggggattcttctgacctgactcaagaccctgctgtgtcagcggccttgggacagacagtcacgatcacatgccaaggagacagcctcaaaacctattatgcaagttgggtccagcaggggccaggacaggcccctctacttggcatctatgccaacaataagcggacctcagggatcccagaccgattctctggctccagggcaggaaacacagctatcttgaccatcactggggctcaggcggaagatgaagctgtctattact

SEQ ID NO: 1003 - DNA, 453 bp, Homo sapiens
ggaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaagtttccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttccatacaagttggcaggaacattatacatggcagtgattctgtggagagtgc

SEQ ID NO: 1004 - DNA, 459 bp, Homo sapiens
ggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctttagtaataatcagcggccctcaggggtccctgaccgattctctggctccaagtctggcacctcagcctccctggccatcagtgggctccagtctgaggatgcggctgattattactgtgcagcatgggatgacagcctgaatggtgtggtattcggcggagggaccaagctgaccgtcctaggtcagcccaaggctgccccctc

SEQ ID NO: 1005 - DNA, 336 bp, Homo sapiens
attctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaacg

SEQ ID NO: 1006 - DNA, 311 bp, Homo sapiens
gtacggctgcgagaagacgacagaaggggatgtataaagggttccaagccttaggggatgccgctgacatccgggtcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttaactcaacgccggggcttcaccaagacctacactgttggctgtgaggaatgcacaatgtttccctgtttatacatcccctgcaaa

SEQ ID NO: 1007 - DNA, 181 bp, Homo sapiens
ctgcaaaacaagatgttaaggtatgcttcaaaaattttgtaaattgtttattttaaacttatctgtttgtaaattgtaactgattaagaattgtgatagttcagcttgaatgtctcttaaagggtgggcttttgttgatgagggaggggaaactttttttttttttataaacttttttcaa

SEQ ID NO: 1008 - DNA, 369 bp, Homo sapiens; identical to SEQ ID NO: 208

SEQ ID NO: 1009 - DNA, 219 bp, Homo sapiens
acgacagaaggggctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctt

SEQ ID NO: 1010 - DNA, 210 bp, Homo sapiens
gcacctctcgccccgcaggaccatggccaacctggagcgcaccttcatcgccatcaagccggacggcgtgcggcgcggcctggtgggcgagatcatcaagcgcttcgagcagaagggattccgcctcgtggccatgaagttcctccgggcctctgaagaacacctgaagcagcactacattgacctgaaagaccgaccattctttcctgg

SEQ ID NO: 1011 - DNA, 318 bp, Homo sapiens
  misc_feature 318: n = A,T,C or G
gcttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccan

SEQ ID NO: 1012 - DNA, 369 bp, Homo sapiens
gctctcgccaggcgtcctcgtggaagtgacatcgactttaaaccctgcgtggcaatccctgacgcaccgccgtgatgcccagggaagacagggcgacctggaagtccaactacttccttaagatcatccaactattgcatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatca

SEQ ID NO: 1013 - DNA, 324 bp, Homo sapiens
ggcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagg

SEQ ID NO: 1014 - DNA, 217 bp, Homo sapiens
acgacagaagggtacggctgcgagaagacgacagaagggtacggctgcgagaagacgacagaaggggcttttcctccttggctgtctgaagatagatcgccatcatgaacgacaccgtaactatccgcactagaaagttcgcgaccaaccgactacttcagaggaaacaaatggtcattgatgtccttcaccccgggaaggcgacagtgcctaagaa

SEQ ID NO: 1015 - DNA, 348 bp, Homo sapiens
gcttttccggttgcggcgccgcgcggagaggttgtctagtccacgctcggagccatgccgtccaagggcccgctgcagtctgtgcaggtcttcgtacgcaagaagacagcgacagctgtggcgcactgcaaacgcggcaatggtctcatcaaggtgaacgggcggcccctggagatgattgagccgcgcacgctacagtacaagctgctggagccagatctgcttctcggcaaggagcgatttgctggtgtagacatccgtgtccgtgtaaagggtggtgtgcacgtggcccagatttatgctatccggcagtccatctccaaagccctgggggcctattaccataga

SEQ ID NO: 1016 - DNA, 324 bp, Homo sapiens
  misc_feature 307: n = A,T,C or G
gagtctgggcctaaggaagcagcactggtggtgcctcagccatggcctggaccgttctcctcctcggcctcctctctcactgcacagggtctgtgacctcctatgcgctggctcaggcgccctcggtgtccgtggccccaggacagacggccacgattacgtgtgggacaaacaacattggagctaagaaagtgcactggtaccaacagaggccaggccaggcccctgtggaggtcggctatgataatgaccaccggccctcatggatccctgagcgattctctggctccaactttgggaacacggncaccctgaccattagca

SEQ ID NO: 1017 - DNA, 381 bp, Homo sapiens
cactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggattcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgag

SEQ ID NO: 1018 - DNA, 689 bp, Homo sapiens
gaatttggccctcgaggccaagaattcggcacgaggaaattagggagactggactgaggactgaaagcttcttccctcatctgatactgaggaatctccgatttgtcaaacagctatttaaaggctttaggtttcaaatcctgcctgacgctgatatatagttaagaaaacaaaggaaagggacccccacgtcgtctttcccagacgtggaggcattccctgtgtgtctctttttctccctccctccccactcctcttctctcccctactcctgccattagcatcactctgtgatccctgacacagcatccccagccctgtcctagagccagggccagtaactcaattagcaacccccagccccagctccctcccctcccctgtgagggacatcgaggagaggagaagaatcggtctgcctcccgaccagttgctgggaggggcaggggttcaccgagccttgtggcccctctgtcaggctgctctggcctgctctgagccaaggcgagaaaggaaaacaagaagatgaatcgccacgtcttcttggtggaggttccgatgagactttagaacaacagtgactggaaagaaaaacagcatctgctggaggagagggggaagaatgggctctgctgggagttgcatttattattatttttctttctaacaacgtgaaatcataatagatg

SEQ ID NO: 1019 - DNA, 341 bp, Homo sapiens
attggctagatgatttttaaaattcatttggaaacacaaatgtcaaaaaaataaacaaaataatcttgaaaagaggccgggtgcggtggctgatgcctgtaatcccagcacttcgggaggctgaggcaggtgaatcacctgaggtcaggagttcaagaccagcctggccaacatggtgaaaccccatctctactaaaaacacaaaaattagccgggcgtggtggcgggcacctgtaatccagctacttgggaggctgaggcaggagaattgcttgaaccctggaggcagaggttgcagtgagccaagatcgcaccattgcactccagcctgggcgacaaga

SEQ ID NO: 1020 - DNA, 382 bp, Homo sapiens
ggagcttcagctgtgggtagagaagacaggactcaggacaatctccagcatggccagcttccctctcctcctcaccctcctcactcactgtgcagggtcctgggcccagactgtgctgactcagccaccctcagcgtctgggacccccgggcagagggtcaccatctcttgttctggaagcagctccaacatcggaagtaatactgtaaactggtaccagcagctcccaggaacggcccccaaactcctcatctttagtaataatcagcggccctcaggggtccctgaccgattctctggctccaagtctggcacctcagcctccctggccatcagtgggctccagtctgaggatgcggctgattattactgtgcagcatgg

SEQ ID NO: 1021 - DNA, 289 bp, Homo sapiens
acagaagggtctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgcattttcaccgagcttatatttggtgtgttttttgtcttttctttatgattatcaataaaatgcaaaaaaaaaaaaaaaaaaaaaaatttttttttttt

SEQ ID NO: 1022 - DNA, 174 bp, Homo sapiens
ggcttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggag

SEQ ID NO: 1023 - DNA, 352 bp, Homo sapiens
aaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcg

SEQ ID NO: 1024 - DNA, 345 bp, Homo sapiens
agtctgggcctaaggaagcagcactggtggtgcctcagccatggcctggacctttctcctcctcggcctcctctctcactgcacaggctctgtgacctccgatgtgctgactcagccaccctcagtgtcagtggccccaggacagacggccaggattacctgtgggggagacaacattggaagtaaaagtgtgcactggtaccagcagaagccaggccaggcccctgtgctggtcatctattatgatagcgaccggccctcagggatccctgagcgattctctggctccaactctgggaacacggccaccctgaccctcagcagggtcgaagccgaggatgaagg

SEQ ID NO: 1025 - DNA, 470 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctacgagaagacgacagaagggagagatacacatgccatgtacagcatgaggggctgccgaagcccctcaccctgagatgggagccgtcttcccagtccaccgtccccatcgtgggcattgttgctggcctggctgttctatcatttgtggtcatcggagctgtggtcgctgctgtgatgtgtaggaggaagagctcagttggaaaaggagggagctactctcaagctgcgtgcatcgacagtgcccagggctctgatgtgtctctcacagcttgaaaagcctgagacagctgtcttgtgagggactgagatgcatgatttcttcacgcc

SEQ ID NO: 1026 - DNA, 503 bp, Homo sapiens
caatgaattacaaaaacttggcagttacagccttttgtcaaatttatctcggcatcctgtacttttatttgctagatttggtggccaaactaatgagccactcaacccctacaatcttccatgtttcagccttctctgtagtatctctcttctaaggtgagtggccacccagcctaatgggcacttcttacctcaggagtttcccaacactgaacgaaaatctgtctccctgaaatttttacctgctgcccctagcatccctctttaagatcatactgaataaatctaatccttttctttacagaagttcaaatattgaactcactgtattagaggccacctcatgtcacagactcttaacaaactttctatgagcccaaaccagtggtgtggtggtaggatttgtagcatttaatttctttggtgaaaatactcctgccacattggagctgcccaggtgaagtggttgaactgagagttgggaactgatggacacattccac

SEQ ID NO: 1027 - DNA, 928 bp, Homo sapiens
ttagaaactgatgtttattttccatcaaccatttttccatgctgcttaagagcctatgcaagaacagcttaagaccagtcagtggttgctcctacccattcagtggcctgagcagtgggagctgcagaccagtcttccgtggcaggctgagcgctccagtcttcagtagggaattgctgaataggcacagagggcacctgtacaccttcagaccagtctgcaacctcaggctgagtagcagtgaactcaggagcgggacgagtccattcaccctgaaattcctccttggtcactgccttctcagcagcagcctgctcttctttttcaatctcttcaggatctctgtagaagtacagatcaggcatgacctcccatgggtgttcacgggaaatggtgccacgcatgcgcagaacttcccgagccagcatccaccacatcaaacccactgagtgagctcccttgttgttgcatgggatggcaatgtccacatagcgcagaggagaatctgtgttacacagcgcaatggtaggtaggttaacataagatgcctccgtgagacgctggtggtcagccctggggtcagtaaccacaagaagccgtggctcccggaaggctgcctggatctggttagtgaaggtttcaggagtgaagcggccagacattggagtgggtcaagtggcagcagcaaacttcagcacagccctctggccagtaatgctggaggattatacactgacatcagcaggggtttcaatggcaacaattgcacgagcttgcagcagaagcttctccaaggtcctcctgagatttatgatatagatgccatcaatttgcctttatagatgtacctgtcatccggcagtcaagatgggtgcagctaagtggtttctgctgcaagaacttaaggcatcccctccttaatttgagg

SEQ ID NO: 1028 - DNA, 478 bp, Homo sapiens
ttttttctacaccaacctgcttccactttattcttgtttacacattctcctgctcccagatttggagggaagaaagcagaagaaaagatgcaggactgagatgattcatggaacccaagtccattaaaactggctgcccctcatctccaagcaatatattggtgggcttcaagtctctgtgggcataacccttggcatgaatggcctcaaggctcctgcagatccccagcagcagccaaaggatttgatcctcggtcaggaagttgcctttgtccttcagcctttctatctcattccacagcgtacctctcttgaagaatggtagcagcagccaggcctcatgcttagcaccccgttccctcagacagtaagccacgagggaaaggatgttggggtgattgaagaggcgatgcatgtcggcttctcgctgggcctcctcccggtcctgctgctcgtgaacaaggattcgcttcagggc

SEQ ID NO: 1029 - DNA, 294 bp, Homo sapiens
gcctgaggtcaggagtttgagaccagcctggccaacataatgaaaccctgtctctactaaaatacaaaaaattagctgggcgtggtggtgggcgcctgtaatctcagctactcagggggctgaggcaggagaatcgcttgaacctgggaggcggaggttgcagtgagccaagatcgcgccattgcactccagcctgggcaacaagagcaaaactccgtctcaaaaaaaaaaaaacagggggggaaaaaaaagggcttgaaattttttaaaaactgcaaatactccagggatata

SEQ ID NO: 1030 - DNA, 309 bp, Homo sapiens
atcaatgctgacttcctcgtcttagaaattgtactattgtgcaggcgcagtggctcacacctgtaatcctagcactttgggaggccgaggtgggcagatcacctgaggttgggagttcaagaccagcctgaccaacatggagaaaccctgtctctactaaaaatacaaaattagctgggcatggtggcgcatgcctgtaatcccagctactcaagaggctgaggcaggagaatcgcttgaacccgggaggcagaggttgcagtgagctgagatcgtgccactgcgttccagcctgggcataaagagtga

SEQ ID NO: 1031 - DNA, 250 bp, Homo sapiens
gtacggctgcgagaagagacagaagggcaagattaagcaaaaagaacaaatctggaggcatcacattacctgacttcaaactatactataaggccacagtcaccaaaacagcatggtattggtataaaaatagacacatagaccaatggaacagaatagagaatccagaaataaagccaaatacttatagccaactgatcttcaacaaagcaaacaaaaacataaaggggtgaaaggacaccctttttca

SEQ ID NO: 1032 - DNA, 452 bp, Homo sapiens
gaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcatgcacatgggcataggtcagcggaagggtacagccaatgcccgaatgccaaagaaggtcacatggatgaggagaatgaggattttgcgccggctgctcaaaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctactggctgaccaggctgatgcccgcaggtctaagaccaaggaagcac

SEQ ID NO: 1033 - DNA, 353 bp, Homo sapiens
tggaagaaaatatctaaatagctaccagaaagagatgctgctgaggttttgaaagacatttggctataatcttatctttgctccctgcaagaaatcagccataagaaagcactattaatactctgcagtggttagaaggggtggggtggcgggaatcctatttatcagactctgtaattgaatataaatgttttactcagaggagctgcaaattgcctgcaaaaatgaaatccagtgagcactagaatatttaaaacatcattactgccatctttatcatgaagcacatcaattacaagctgtagaccacctaatatcaatttgtaggtaatgttcctgaaaattgcaataca

SEQ ID NO: 1034 - DNA, 295 bp, Homo sapiens
  misc_feature 170: n = A,T,C or G
ggaaatgtctttaccatcttcctcctggaggccaagacatcctgtttctaagggctgctttgtttggcgtgtggttgttatcacgcgaattagacgcttgaaagatgggcgtcagacttgcatacgcagcagatcagcatccttcgctgccccttagcaacttatgtggntgatttgaaactgtgaaggtgtgattttttcaagagctggaagtcttaaaaaagccttgtaaatgcctatattgtgggcttttaacgtatttaatggaccacttaagacgagattagatgggctg

SEQ ID NO: 1035 - DNA, 284 bp, Homo sapiens
cagaagggttctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttt

SEQ ID NO: 1036 - DNA, 326 bp, Homo sapiens
agggttctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttttccacagggctttttttaaagttttggaaaattttttttgcccctt

SEQ ID NO: 1037 - DNA, 329 bp, Homo sapiens
tgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatg

SEQ ID NO: 1038 - DNA, 305 bp, Homo sapiens
  misc_feature 151, 305: n = A,T,C or G
ctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagntgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacn

SEQ ID NO: 1039 - DNA, 347 bp, Homo sapiens
ggaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggcggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagggacaggaagatggttggcgacgtgaccg

SEQ ID NO: 1040 - DNA, 178 bp, Homo sapiens
gcggcccctactactactactatacggctgcgagaagacgacagaagggatgagatgatgttgacaatatagcctgacgtgccggaccttccacctcaaattataaagacaaactttgttttgtttgtgctctgactgattaggactgacaattaacagcaaaaaaaaaaaaagtcgt

SEQ ID NO: 1041 - DNA, 437 bp, Homo sapiens
gggtctctcctcccgccgcccaagatgccgaaagggaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagc

SEQ ID NO: 1042 - DNA, 530 bp, Homo sapiens
gacagaaggggcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgtaatgactattttgtagtacacatgaagcagaagggaaagaagtaggcagaaatgagcagttcgctcctccttgataagagttgtcccaaagggtcgcttaaggaatctgccccacagcttcccccatagaaggatttcatgagcagatcaggacacttagcaaatgtaaaaataaaatctaactctcat

SEQ ID NO: 1043 - DNA, 536 bp, Homo sapiens
actcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgc

SEQ ID NO: 1044 - DNA, 309 bp, Homo sapiens
aaactattccaaacaatagaaaaagagggactcctcccaaactcattttatgaggccagcatcatcctgataccaaagcctggcagagacacaacaaaaaaagaaaatttcaggccaatattcctgatgaacattgatgcaaaaaatcctcaataaaatactggcaaaccaaatccagcagcacatcaaaaagcttatctaccatgatcaagtcggcttcacctctgggatgcaaggctagttcaacatattcaaatcaataaatgtaatccatcacataaacagaaccaatgacaaataccacatgag

SEQ ID NO: 1045 - DNA, 352 bp, Homo sapiens
ggaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccg

SEQ ID NO: 1046 - DNA, 334 bp, Homo sapiens
gacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtga

SEQ ID NO: 1047 - DNA, 331 bp, Homo sapiens
gctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagaga

SEQ ID NO: 1048 - DNA, 339 bp, Homo sapiens
gcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgg

SEQ ID NO: 1049 - DNA, 348 bp, Homo sapiens
atggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggccc

SEQ ID NO: 1050 - DNA, 348 bp, Homo sapiens
  misc_feature 348: n = A,T,C or G
gggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagataaagttcagtgggaagcn

SEQ ID NO: 1051 - DNA, 125 bp, Homo sapiens
tatacggctgcgagaagacgacagaagggacaaaacgaactgcacagaaccgcaccacaggcgtctgcttgcgtcaataagcattaaaacataccatgctgcgttaataaattgcctcattccaa

SEQ ID NO: 1052 - DNA, 143 bp, Homo sapiens; identical to SEQ ID NO: 277

SEQ ID NO: 1053 - DNA, 736 bp, Homo sapiens; identical to SEQ ID NO: 264
  misc_feature 608: n = A,T,C or G

SEQ ID NO: 1054 - DNA, 330 bp, Homo sapiens
tttttaaaaagaaaggccttacatatttattactgaatccagccaaccaacgtgttcataacagattcagagaggaaaacacgtcgaaatctccagatagtggtgacattttcagcttgatatggtaacatgatcgtgaccttcagacagcataaatatgtgtgccatctcatgtgcaattccttatagacccagcttggttcttctccaatgtctccttttggagttgtacctgattttatttccagttttcatcccattccccagtggattcggatgaaaactggaaataaaatcatgtgcaattccttatagacccagcttggttct

SEQ ID NO: 1055 - DNA, 786 bp, Homo sapiens
  misc_feature 522, 575, 669: n = A,T,C or G
ttttttgaaatgcagaaatatttattttggtttccttcattgtttttggaaattttgttttggtttataaaacatagaaatagccaacacttaaagcaaacattcaaaaccccaaggtgacaaattattgactttttgtgcaattaagaatacatatatgaagttaggctaccaagtagtgttattacaatgacaattctttagtgcaagccctgttgtgcttgtatataatacatgtactctcacagaccccaaaacagctgctttaaatgtacaaatgacagctcaattcagtcaaatgtggcaaagactcacaataaagtgaactgctgttaatttcccaaattaactttaaaaaatccctggagaagtgaatcccaggaaatgaactttccagatttctacatcctagaattttggcttgtcaaacacatttcatagaaatcaggtagcattataagaacatttgcttattactgtccatttcaataagtactcaagtatatactcccttaatagctntaaagaaatgcttgcctgagagtttattttttggggaaaaagggcagttaatnccaacatgatcttttgatatgaaaaccacattaaaaatctgtttggctttacacagagtgagtggttcagtgaagataagtagacagttatcangcgtcacagctgagcatggctgatccaggtactctttcttgaaatgcttggctcactatagaatctacgcagattttaaaataaccctgaaaaaggatgagtcggggatcaggcctg

SEQ ID NO: 1056 - DNA, 445 bp, Homo sapiens
cggctgcgagaagacgacagaaggggcttttccggctgcggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagct

SEQ ID NO: 1057 - DNA, 446 bp, Homo sapiens
cgacagaagggtacggctgcgagaagacgacagaagggtacggctgcgagaagacgacagaagggtacggctgcgagaagacgacagaagggtacggctgcgagaagacgacagaaggggaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttt

SEQ ID NO: 1058 - DNA, 363 bp, Homo sapiens
gaggatttttgcatcaatgttcatcaaggatattggtctaaaattctcttttggttgtgtctctgccaggctttggtatcaggatgatgctggcctcataaaatgagttagggaggattccctctttttctattgattggaaaagtttcagaaggaatggtaccagttcctccttgtacctctggtagaattcggctgtgaatccatctggtcctggactctttttggttggtaagctattgattattgccacaatttcagagcctgttattggtctattcagaaattcaacttcttcctggtttagtcttgggaggggggtcgccgcacatggattattcaattggtgtgctcacccccccc

SEQ ID NO: 1059 - DNA, 310 bp, Homo sapiens
tgaaagtacgtagttgtctttcgtaggttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggagactccggtgaagcctgttcagccgtctgtgtcatgtggacatcttgagtctactctgtcgctctt

SEQ ID NO: 1060 - DNA, 521 bp, Homo sapiens
gctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcacaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgat

SEQ ID NO: 1061 - DNA, 283 bp, Homo sapiens
cggctgcgagaagacgacagaaggggcttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccactttcgggcccccagccgca

SEQ ID NO: 1062 - DNA, 510 bp, Homo sapiens
tacggctgcgagaagcgacagaagggtacggctgcgagaagacgacagaagggtacggctgcgagaagacgacagaagggggagtcctgagctgcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgt

SEQ ID NO: 1063 - DNA, 258 bp, Homo sapiens
cggctgcgagaagacgacagaagggggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttctt

SEQ ID NO: 1064 - DNA, 199 bp, Homo sapiens
gagaagactacagatggggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaag

SEQ ID NO: 1065 - DNA, 290 bp, Homo sapiens
tcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggaggccaccgccatccgtggggccatcatcctggccaagctctccatcgtccccgtgcgcagaggctactgggggaacaagatcggcaagccccacactgtcccttgcaaggtgacaggccgctgcggt

SEQ ID NO: 1066 - DNA, 318 bp, Homo sapiens
gctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacgg

SEQ ID NO: 1067 - DNA, 321 bp, Homo sapiens
gttgtgttgagatccagtgcagttgtgatttctgtggatcccagcttggttccaggaattttgtgtgattggtttaaatccagttttcaatcttcgacagctgggctggaacgtgaactcagtagctgaacctgtctgacccggtcacgttcttggatcctcagaactctttgctcttgtcggggtgggggtgggaactctcgtgaggagcgccagctgtgtaaatgccacgactccgtaattcttattcggtgggaccttgcttccctctgggagctggctcgttttgttggtgtctaacctttcgccgaatcgttaaag

SEQ ID NO: 1068 - DNA, 351 bp, Homo sapiens
ggccaggcgtcctcgtggaagggacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgccccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggac

SEQ ID NO: 1069 - DNA, 317 bp, Homo sapiens
  misc_feature 317: n = A,T,C or G
gttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggagcatcctatgagttttcttagaatgtataaaggttgtagcccatccaacttcaaagaaaaaaatgaccacatactttgcaatcaggctgaaatgtggcatgcttttctaattccaactttataaactagtaaaaaagtgtttgcttattccaccagttctacn

SEQ ID NO: 1070 - DNA, 383 bp, Homo sapiens
atggagatgaaccaggggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgaaaagaaacacgtttggtttggagagtccatggatggtggttttcagtttagctacgggatatctggaacttcctga

SEQ ID NO: 1071 - DNA, 354 bp, Homo sapiens
gacgacagaagggtacggctgcgagaagacgacagaagggtacggctgcgagaagacgacagaagggtaccagcgttatgagatcaagatgaccaagatgtataaagggttccaagccttatgggatgccgctgacatccggttcgtctacacccctgccatggagagtgtctgcggatacttacacaggtcccacaaccgcagcgaggagtttctcattgctggaaaactgcatgatggactcttgcacatcactacctgcagttttgtggctccctggaacagcctgagcttagctcagcgccggggcttcaccaagacctacactgttggctgtgaggaatgcacagtgtt

SEQ ID NO: 1072 - DNA, 411 bp, Homo sapiens
gcttccttttgcgggtggcggcgaactcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccat

SEQ ID NO: 1073 - DNA, 455 bp, Homo sapiens
aggggctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatcct

SEQ ID NO: 1074 - DNA, 497 bp, Homo sapiens
tacggatacgagaagacgacagaagggtacggctgcgagaagacgacagaagggtacggctgcgagaagacgacagaagggtacggctgcgagaagacgacagaaggggctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcatacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctaaccaatggtctggacaacaagctccgtgaagagctggagcgactga

SEQ ID NO: 1075 - DNA, 351 bp, Homo sapiens
  misc_feature 273: n = A,T,C or G
ggcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcanggccggttgtggccatggtctgggaggggctgaacgtggtgaaaacaggccgagtgatgcttggggagaccaatccag

SEQ ID NO: 1076 - DNA, 414 bp, Homo sapiens
cagaagggggagaaccatcccggtaacccgatcaccgctggtcaccatgaaccacattgtgcaaaccttctctcctgtcaacagcggccagcctcccaactacgagatgctcaaggaggagcaggaagtggctatgctgggggcgccccacaaccctgctcccccgatgtccaccgtgatccacatccgcagcgagacctccgtgcctgaccatgtcgtctggtccctgttcaacaccctcttcatgaacacctgctgcctgggcttcatagcattcgcctactccgtgaagtctagggacaggaagatggttggcgacgtgaccggggcccaggcctatgcctccaccgccaagtgcctgaacatctgggccctgattttgggcatcttcatgaccattctgctcatcatcat

SEQ ID NO: 1077 - DNA, 262 bp, Homo sapiens
tacggctgcgagaagacgacagaaggggtggccggcgtggtgtcctaccccttcgacacggtgcggcggcgcatgatgatgcagtccgggcgcaaaggagctgacatcatgtacacgggcaccgtcgactgttggaggaagatcttcatagatgaggggggcaaggccttcttcaagggtgcgtggtccaacgtcctgcggggcatggggggcgccttcgtgctggtcctgtaccacgagctcaagaaggtgatctaagggc

SEQ ID NO: 1078 - DNA, 478 bp, Homo sapiens
acttttacgtataattttattttatttcatatatttcctattggctttttacatttaaattatggagcacttcatcatataaaaaacttcaattatatttaaacagtaagtctttggatttttttgccttgtaatttccatattacataataatgagataaacattaatgttttcagggtactttaaattttagataattactcattgtattcatgtgaaatttgtttttactgcatgtgtgggttggaggactgttttcacttctgattcatctttactcttatctcatcagagctcatacctcttgtagttgggggattgcagtttataattccaataaatggggcaaattcaataataacataatacaaatgagtttgaatgcaggacaggtcttcaaagcatacacaacatgggcctacatatgtacaacaataataatttataagttactgtttggatggaaagtaaaagtac

SEQ ID NO: 1079 - DNA, 217 bp, Homo sapiens
agacgacagaagggtacggctgcgagaagacgacagaagggtacggctgcgataagaccacagaagggtacggctgcgagaagacgacagaaggggctcctcttcctttctccgccatcgtggtgtgttcttgactccgctgctcgccatgtcttctcacaagactttcaggattaagcgattcctggccaagaaacaaaagcaaaatcgtcccatg

SEQ ID NO: 1080 - DNA, 334 bp, Homo sapiens
ggctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgt

SEQ ID NO: 1081 - DNA, 202 bp, Homo sapiens
acgacagaagggtacggctgcgagaagacgacagaagggtacggctgcgagaagacgacagaagggctacaagagcccctgcccctctgttggaggcacagttttagaataaggaggaggagggagaagagaaaatgtaaaggagggagatctttcccaggccgcaccatttctgtcactcacatggacccaagataaaaga

SEQ ID NO: 1082 - DNA, 335 bp, Homo sapiens
ggttggggtctcaggaggcagcgctctcgggacgtctccaccatggcctgggctctgctattcctcaccctcctcactcatggcacagggtcctgggcccagtctgccctgactcagcctgcctccgtgtctgggtctcctggacagtcgatcaccatctcctgcactggaaccagcagtgacgttggtggccataactatgtcgcctggtaccaacaacacccaggcaaagcccccaaactcatcgtttatgatgtccgtcatcggccctcacggggttctgatcgcttctctggctccaagtctggcaacacggcctccctgaccatctctgg

SEQ ID NO: 1083 - DNA, 343 bp, Homo sapiens
gaacactgagtggggtgacaatggcttctttaaaatactcagaggacaggatcactgtggaatcgaatcacaagaggtggctggaattccacgcaccgatcagtactgggaaaagatctaatctgccgtgggcctgtcgtgccagtcctgggggcgagatgggggtagaaatgcattttattctttaagttcacgtaagataccagtttcagacagggtctgaaggactggattggtcaaacatcagacctgtcttccaaggagaccaagtcctggctacatcccagcctgtggttacagtgcagacaggccatgtgagccaccgctgccagcacagagcgtg

SEQ ID NO: 1084 - DNA, 324 bp, Homo sapiens
aaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagat

SEQ ID NO: 1085 - DNA, 350 bp, Homo sapiens
gactcaaaagcttggaccgcatcctagccgccgactcacacaaggcagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagg

SEQ ID NO: 1086 - DNA, 329 bp, Homo sapiens
gcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcataggattatacggggcatctactcaatgaaaaaccatgataattctttgtatatataatatacatttggtcataccatactcgtttgtttattaatatgctacttcgtgggtg

SEQ ID NO: 1087 - DNA, 316 bp, Homo sapiens
tggggaattgcgcttccgccatctttccagcctcagtcggacgggcgcggatacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtaaccaccttgggtgttgaggttcatcccctagtgttccacaccaacagaggacctattaagttcaatgtatgggacacagccggccaggagatattcagtggactgagagatggctattata

SEQ ID NO: 1088 - DNA, 449 bp, Homo sapiens
agttgaaatctggaactgcctctgttgtgtgcctgctgaataacttctatcccagagaggccaaagtacagtggaaggtggataacgccctccaatcgggtaactcccatgagagtgtcacagagcaggacagcaaggacagcacctacagcctcagcagcaccctgacgctgagcaaagcagactacgagaaacacaaagtctacgcctgcgaagtcacccatcagggcctgagctcgcccttcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctacttggctttaattatgctaatgttggaggagaatgaa

SEQ ID NO: 1089 - DNA, 147 bp, Homo sapiens
gagaagacgacagaagggacaaagagatctggacagaatcgccggacaggtggcaactgccaacaagaagcattagaacaaaccatgctgggttaataaattgcctcattcgcaaaaaaaaaaaaaaaaaaaaaaaaaaagtcgtat

SEQ ID NO: 1090 - DNA, 166 bp, Homo sapiens
cggagtgctgtgccacctggtgccgacaagaaagccgcggctgatgctgggtcagcaaccgaattccattttagaggcggatttggtcgtggacgtggtcagccacctcagttaaattggagaggattcttttgcattgaataaacttacagtcaaaaaaaaaaaa

SEQ ID NO: 1091 - DNA, 464 bp, Homo sapiens
tttttttttttttttttttttttttttttttttgaggaattaacagtctttattgggctcaaaccaggagtccgggggtcttgaggacctctgggtatttgtcaatttttttctccacgttcttttgggcctgctcctgaaggaaggagcaaatctgctggaaggggggtctgggggtgggctccaaggcccagcaggcctgcatgatgctgtatatattctttggggcaaatgcaggctgggccatttggtatccatcctttaccagtttatagaacttgctgttcaccaggatgccagggtagggattcagcccaagtgagaagatctcccagaggaggatgccataggaccagacgtcgctctgaaccgtgtagacccagtcaaagatgctctctggggccatccacttaacaggcaggcgggcattgcccttgacaatgtatttggagtcattcatgatg

SEQ ID NO: 1092 - DNA, 511 bp, Homo sapiens
cggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatg

SEQ ID NO: 1093 - DNA, 394 bp, Homo sapiens
gcttatccaaacggctgccgaagatggcggaggtgcacgtcctggtgcttgatggtcgaggccatcttctgggccggctggcggccatcgtggctaaacaggtactgctgggccggaaggtggcggtcgtacgctatgaaggcatcaacatttctggcaatgctctacagaaacaagttgaagtacctggctctcctccgcaagcggatgaacacctacccttcccgaggccactaccacttccggacccccatacgcatcttctggcggaccgtgcgaggtatgctgccccacacaaccaatcgaggccaagccgatctggaccgtctcaaggtgtttgacggcatcccaccggcctacgacaataaaaagcggatggtggttcctgctgccc

SEQ ID NO: 1094 - DNA, 535 bp, Homo sapiens
cggctgcgagaagacgacagaaggggccttttccggaaaaggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactc

SEQ ID NO: 1095 - DNA, 480 bp, Homo sapiens
aaaggagactgctatcaggttctaatacaagactgtatcccggtactgaagaggtacgccaaagaagggagagaattcgattatgtgattaatgatttgacagctggtccaatctccacgtctccagaagaagattccacatgggagttactcagactgattcttgacctctcaatgaaagtgttgaaacaggatgggaaatattttacacaggggaactgtgtcaatctgacagaagcactgtcgctctatgaagaacagctggggcgcctgtattgtcctgtggaatcttcaaaggagatcgtctgtgtcccttcatacttggaattgtgggtattacacactgtttggaagaaagctaaaccctgaagatcagtatcccctaatcacatgtgctgcaaatagccttactgacctccatattgctgtacatgacatcaaaatgagtcaggcaattgattgtgaattccttaaagtttt

SEQ ID NO: 1096 - DNA, 495 bp, Homo sapiens
cttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgactt

SEQ ID NO: 1097 - DNA, 378 bp, Homo sapiens
gagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagatctggaaaacagtcagggtcagctgatctacgagtctgccatcacctgtgagtacctggatgaagcatacccaggtaagaagctttttctgtatgaaccctttttaaaaacgtcgccagaaaaaggac

SEQ ID NO: 1098 - DNA, 209 bp, Homo sapiens
ctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaa

SEQ ID NO: 1099 - DNA, 499 bp, Homo sapiens
acagaagggtacggctgcgagaagacgacagaaggatacggctgcgagaagacgacagaagggtacggctgcgagaagacgacagaagggtacggctgcgagaagacgacagaagggtacggctgcgagaagacgacagaagggtacggctgcgagaagacgacagaagggaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgtaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttttt

SEQ ID NO: 1100 - DNA, 309 bp, Homo sapiens
tggctcatgcctgtaatcccagcactttgggaggccaaggagggcggatcgcttgaggtcaggagttcgagaccagcctggccaacatggtgaaaccctgtctctactaaaaatataaaaattagccaggcatggtggtgcacacctgtaatccccactactcaggaggctgaggcaggagaattgcctgaatctgggaggtggaggttgcagtgagccgagattgcaccactgcactccagcctgggtgacaagagcaaaactccgtctcaaaaaagaaaaaaagtataaaaaagaaaaaggttttgg

SEQ ID NO: 1101 - DNA, 514 bp, Homo sapiens
cagaaggggatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaagattttgttcatactgtatttatcaagtatgatgaaaagcaatagatatatattcttttattat

SEQ ID NO: 1102 - DNA, 510 bp, Homo sapiens
gggtacggctgcgagaagacgacagaagggtacggctgcgagaagacgacagaagggtacggctccgagaagacgacagaaggggcttcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctgg

SEQ ID NO: 1103 - DNA, 527 bp, Homo sapiens
acagaaggggctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgag

SEQ ID NO: 1104 - DNA, 109 bp, Homo sapiens
cggctgcgagaagacgacagaaggggagcagtggtgtgtgagagccaagcgtccctctggctgcccactcagtggcaacacccgggagctgttttgtcctttgtggagc

SEQ ID NO: 1105 - DNA, 131 bp, Homo sapiens
cagaagggttttcttgatgtctcataacttctcctttctcttcccacattccgaaaatcctcctatcctaaccttgctacatgaatggtaactgcttgaacacttgtgattggaatgactgatttaaaaag

SEQ ID NO: 1106 - DNA, 340 bp, Homo sapiens
ggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcagtggaaccagcagtgacgttggtggttatgaccatgtctcctggtaccaacaacacccaggcaaagcccccaaactcataatttctgatgtcagtaatcggccctcaggggtttctaatcgcttctctggctccaaatctggcaacacggccttcctgaccatctctgggctcc

SEQ ID NO: 1107 - DNA, 343 bp, Homo sapiens
agcttttccgtgctacctgcagaggggtccatacggcgttgttctggattcccgtcgtaacttaaagggaaattttcacaatgtccggaacccttgatgtcctgcaaatgaaggaggaggatgtccttaagttccttgcagcaggaacccacttatgtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagaaggctgtgcg

SEQ ID NO: 1108 - DNA, 429 bp, Homo sapiens
cggctgcgagaagacgacagaaggggctctcgctcgggttttctgccgtcatcttggttccgagttccctgcacagcctcctttttattcccttccttcagaaatgcccggcgaagccacacaaaccgtccctgctacagagcaggagttgccgcacccccaggctgatacagggtctggaacagaatctgacagcgatgaatcagctaccagatcttgaagaacaggattccacccacgcaaccacacaacatgcccagctggcggcagcagctgaaatcgatgaagaaccaggcagcaaagcacaacagagtcggagtgaaaagaaggcaccgaatgctatgtgcaaactgggtcttctgcaggttacaggagttactagagtcactatccggaaatctaagaatatcctctttgtcatcacaaaac

SEQ ID NO: 1109 - DNA, 313 bp, Homo sapiens
  misc_feature 313: n = A,T,C or G
gctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaagaaaccatctgccgtgtgactggtgggatgaaggtaaaggcagaccgagatgaatcctcaccatatgctgctatgttggctgcccaggatgtggcccagaggtgcaaggagctgggtatcacn

SEQ ID NO: 1110 - DNA, 333 bp, Homo sapiens
gcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttca

SEQ ID NO: 1111 - DNA, 488 bp, Homo sapiens
tacggctgcgacaagacgacacaaggatacggctgcgacaagacgacagaagggtacggctgcgacaagacgacagaagggtacggctgcgacaagacgacagaagggtacggctgcgagaagacgacagaagggtacggctgcgagaagacgacagaagggaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgtaaagagtgcaaatgcaccttctgcgagaagagctgctgctcctgctgacctgtgggctgtgccaagtgtgcccagggctgcatatgctaagggacgttagacaagtgcagctgctgtgcctgatgccaggacagctgtgctcttacatgtaaatagagcaacctatataaacctggattttttttttttttt

SEQ ID NO: 1112 - DNA, 321 bp, Homo sapiens
catgtaatcccagcactttgggaggctgaggcgagggcatcacctgaggtcaggagttcaagaccagcctggccaatatggtgaaacccggtctctactaaaaatacaaaaaattagctgggcatggtggtgggtgcctgtaatcccagctacttgggaggctgaggcaggagaattgcttgaacccgggaggcggagattgcagtgaaatgaggtcgtgccattgcactccagcctgggcaacaagagcgaaactccatctcaaaaaaaaaaacttatctttgttccagccatcacctggcacaattacggaacataatt

SEQ ID NO: 1113 - DNA, 239 bp, Homo sapiens
cgaccagacggaaccatggaagccccagcgcacgttctcttcctcctgctactctggctcccagataccactggagaaatagtgatgacgcagctccagtcaccctgtctgtgtctccaggggaaagagccaccctctcttgcagggcagtcagagtgttgacagcaacttagcctggtaccagcagaaacctggccaggctcccaggctcctcatctatggtgcatccaccagggcca

SEQ ID NO: 1114 - DNA, 530 bp, Homo sapiens
cagaagggtacggctgcgagaagacgacagaagggctttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaaaaaaaaaa

SEQ ID NO: 1115 - DNA, 335 bp, Homo sapiens
  misc_feature 335: n = A,T,C or G
gatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttatgggatgccgctgacatccggttcgtctacacccccgccatggagagtgtctgcggatacttccn

SEQ ID NO: 1116 - DNA, 335 bp, Homo sapiens; identical to SEQ ID NO: 1115
  misc_feature 335: n = A,T,C or G

SEQ ID NO: 1117 - DNA, 299 bp, Homo sapiens
ggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcg

SEQ ID NO: 1118 - DNA, 466 bp, Homo sapiens
taactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggttttttttt

SEQ ID NO: 1119 - DNA, 160 bp, Homo sapiens
gagaagacgacagatgggtcaaatagctccagcccagatagcacctgcttcaaaggcatctggcaagaaagcataagtggccacccttaaaaggtattaaaggttttttctgacctgttgcgaaaaaaaaaaaaaattaaaatataaaatctcgcatcgt

SEQ ID NO: 1120 - DNA, 155 bp, Homo sapiens
gagaagacgacagaagggactaagagctgcatcctttaccgcacctgtttcatacgcgtctggccagatagcatctggctctgtcatggaaagtgatcctggctctttatcacctgccggggaaataaaaatgtggactgccaaaaagtcgtatc

SEQ ID NO: 1121 - DNA, 446 bp, Homo sapiens
ggcgcttccgccatctttccagcctcagtcggacgggcgcggagacgcttctggaaggaacgccgcgatggctgcgcagggagagccccaggtccagttcaaacttgtattggttggtgatggtggtaccggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatatta

SEQ ID NO: 1122 - DNA, 498 bp, Homo sapiens
gggctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggca

SEQ ID NO: 1123 - DNA, 495 bp, Homo sapiens
gcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgt

SEQ ID NO: 1124 - DNA, 551 bp, Homo sapiens
aaatttattattcttacaggttaggaatacgagtaaaaataagtaatattttcccttacagaaaattgtaatgataccattgagtacaattaaacaccctgagaatttcacagaaacatcagaattttaatagacagtagccatcgtccttgtggccagtgtgagtgacttctcacagctgcaaacaccctgggccagatttcttaaaacagttacatgacaaaaacaatgttattgatatccaataatgctaaagcctgggtacaccccgtctcactgactggggtttccaaacatctctccactgactgtggtttttcaccaaaggaaaggtaaatggaatattctttgtgccttccatcctagacacaactccggacctaagtacatgggttggtgagtccgtacccgtttggaagtttgaatttcttcttttttccgtgtgacttttgtacggagttttgtatagatgacctgctatctatattcccatgtatttgtgtttttacgcgtggatgaatctttctcctctttgcttacatgtctttctg

SEQ ID NO: 1125 - DNA, 613 bp, Homo sapiens
tcacactacaatagttaattttatttgttcaagagctcagattgcaagcattaaaccaagcataggctttgattctgtgagcccaaattcacatattgaagaagatcaaagcaaactgtgatccatgtacatggatgaaaactaaaggctcgagttaatcacattgtagtttttaaatttctacagcctagagctcactagtcacaggtcttttaggtccttctggatgtcccacagggtatctgcacttttcttgagctgagcaacctcatcatcctttagcttctggttgataacgctggttaatccccgggcattgaggatacatggaaggctcaggaagacttcattctcaatgccatacatcccctttaccattgttgacacgggatgaatcctggatagatttttcaacatggattcaataagatcagccacacttaatccaatagcccagttggtatatccttttagcttgatgacttcataggcactttcaaccaccatcttatgcacttccttccaattttcactatcattgtcagttcccatttctggattcaattcctggagagaaacacctgccacattcacaccactccacacagccaca

SEQ ID NO: 1126 - DNA, 478 bp, Homo sapiens
tctgggcttttcttccacacagtcaaggtccttagtatttcagatgtgttaggtcgatcctcaggtttctttgagagtaatttctgtagaagagttttttcttttttatcaaatatatctgagatgatgccatcccgtaggtctgtgaaaaactttgatgtttcaaaagcagtgtcacatacatgaagaagttcagcaagaattagccccaaagcgtagaggtccacttcctttccatagtcttgcgaagaaatctgttctgggctcatgtatcgcaaagttcccttactccttgttcgctttccatcatttttcagagatgttacaagtccaaagtctccaatctttacttgttttgtatctactaagaatatattacttggcttaagatctctatgaattaatttttttgaatgtatataatccaccccttttgttatttgttcaaagagttccaaagccaaaactttgtctagtt

SEQ ID NO: 1127 - DNA, 833 bp, Homo sapiens
tttttttttttttttttttttttttttcacaaatagcactttttatttgccactatttgaagtctgaactttaaacagattcttggactggtggttcatatccatcagctcgttcaactttagcacctgtctcgtccccagtggcttttccagaactactgccttcaccatgaagctccatgagctttcccaattcaaacttgggcttcttcagcatttttacttttctaacgaagacatcatggagaggataaatagattggcaagccttttctatgtcttttccaatgctgtctggaatcaatttattgaccacttctttcaagtcatttgtctgcacctctcgggtcatgatttccatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctgccattttttgaccatggaacacattttgtcacgggtaagatccatgccatggaagttagtcaggcagtttttaccctgaacatcttcagtaatcagcttgaattttctaaatgcaacttcatcattctgcaaatcagcaagactcacttcaaacacacgacccttgagaccatcagatgcaattttgggtccttggggtcctggtgacgagcgtcttttccatattctctatattgaacatagcaggtgtttcacatcataccaacctttctaggaaatggatcatccatttcctcttggctcccttttggcggctttc

SEQ ID NO: 1128 - DNA, 893 bp, Homo sapiens
tagaaactgatgtttattttccatcaaccatttttccatgctgcttaagagcctatgcaagaacagcttaagaccagtcagtggttgctcctacccattcagtggcctgagcagtgggagctgcagaccagtcttccgtggcaggctgagcgctccagtcttcagtagggaattgctgaataggcacagagggcacctgtacaccttcagaccagtctgcaacctcaggctgagtagcagtgaactcaggagcgggacgagtccattcaccctgaaattcctccttggtcactgccttctcagcagcagcctgctcttctttttcaatctcttcaggatctctgtagaagtacagatcaggcatgacctcacatgggtgttcacgggaaatggtgccacgcatgcgcagaacttcccgagccagcatccaccacattaaacccactgagtgagctcccttgttgttgcatgggatgggcatgtccacatagcgcagaggagaatctgtgttacacagcgcaatggtaggtaggttaacataagatggctccgtgagaggctggtggtcagccctggggtcaagtaacacaagaagccgtggctccgggaagctggctggatctggttagtggaggttcaggagtgaagcggccagcaattggagtggcttccagtggcagagcaaacttcaggccagcccttctggccggtatttccggagaattataacactgactcagacaggtttttcaatgggaacaatttgccgggctgcccagcgaaagtctctcccggggcctttctgaatttttgaatagagaggcccacttttctccttttagaaatgtatcttccctccggaaggtaagtattggtgccactcaatgggttcc

SEQ ID NO: 1129 - DNA, 226 bp, Homo sapiens
ttgctccttgtcgccctatcctacactctggccagagataccacagctgaacctggagccaacatggacacagaggactctcagacccaaactgccccacaccctctgcagaggttgtggtgaccaactcatgtggactcatacatatgaagaagctctatacatatgcaagacatgcatcacacccttgatgattattcatcacttggatgagtgcccacacagt

SEQ ID NO: 1130 - DNA, 207 bp, Homo sapiens
atggatcacctgaggtcaggagtttgagacgagcctggccaacatggtgaaaccctgtctctactaaaaatacaaaaaattatccaggcatggtggcgggcgcctgtaatcccagctacttgggaggctgaggcaggagaattgcttgaacctgggaggcataggttgcagtgagccgagatcgcaccactgcactccagcctgggc

SEQ ID NO: 1131 - DNA, 337 bp, Homo sapiens
ggtagtcccagccacttgggaggctgaggtgggaggattacctgagcccaggaggcagaggctgcattgagccaagatcatgccacagcactctagcctgggtgacagagtgagaccctgtctcaaaaaataaataagtaaatataataaaaataataactaataggccgggcgcagtggctgatgcctgtaatcccagcactttgggaggctgaggttggtggatcacctgaggtcaggagttcgagaccagcctggccaacgtggtgaaaccccatctctactaaaaacacaaaaattagctgggtatggtggcaggcacctgtaatcccagctt

SEQ ID NO: 1132 - DNA, 308 bp, Homo sapiens
tgctattgctgtatggctgggagctaccagactggacaacacagatagagaagcctcatagcatcccataaagttgcattgaaatgtgctgatcaagggcaggagttcaagaccagcctggtcaacatggtgaaaacctgtctctactaaaaatacaaacatgagctgggtgtggtggtgtgcacctgtaatcatagctacttgggaggctgaggcaggagaatcgcttgaacccaggaggtggagattgcagtgagccgagattgcgccactgctctccagcctggagacagagtgagactccatct

SEQ ID NO: 1133 - DNA, 203 bp, Homo sapiens
acgacagaaggggaagctgctcatgatggctggtatcgatgactgctacacctcagcccggggctgcactgccaccctgggcaacttcgccaaggccacctttgatgccatttctaagagctacagctacctgacccccgacctctggaaggagactgtatttaccaaggctccctatcaggagttcactgaccacctcgtcg

SEQ ID NO: 1134 - DNA, 333 bp, Homo sapiens
gctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagacca

SEQ ID NO: 1135 - DNA, 325 bp, Homo sapiens
tgagcactctgtcactagggtatataagccaggatggacacagggaaggacatttctgcatcagtggtgggtccccatcagttaagagagcctgtgactctgtcgagggaccatggggggtggcaccagagcccagggcacctgagggcctgtctggatgcagctgctagtggtcataggacagcaaacactattcattggattctgacttaggcaggtaccctgccgagtgccttaaaggtgtaatctcagttactcttcacagtacattaaaaaaatagttggctgggtgcagtggctcaggccaggcgcggtggctcatgcc

SEQ ID NO: 1136 - DNA, 451 bp, Homo sapiens
acagaaggggtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttg

SEQ ID NO: 1137 - DNA, 639 bp, Homo sapiens
attctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactca

SEQ ID NO: 1138 - DNA, 399 bp, Homo sapiens
cacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttat

SEQ ID NO: 1139 - DNA, 501 bp, Homo sapiens
ggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctca

SEQ ID NO: 1140 - DNA, 505 bp, Homo sapiens
ctgaggcccagaggcctgcaagggagtgagttgatagcacagaccctgccctgtgggccccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacctcttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaagggggaagttgtagg

SEQ ID NO: 1141 - DNA, 267 bp, Homo sapiens
caacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctct

SEQ ID NO: 1142 - DNA, 563 bp, Homo sapiens
taagctcggaattcggctcgaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaa

SEQ ID NO: 1143 - DNA, 571 bp, Homo sapiens
cccagcatcaccaaccgagtttggggtaccccccctcacctgccaatttcatccagccagggaagcagccgctctcgtccattgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctcc

SEQ ID NO: 1144 - DNA, 188 bp, Homo sapiens
gccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagc

SEQ ID NO: 1145 - DNA, 318 bp, Homo sapiens
ttttttttttttttttttttttttttccaagttttatgatttatttaacttgtggaacaaaaataaaccagtttaaccacaaccatgccttactttatcaaatgtataagaagtaaatatgaatcttatatgacaaaatgtttcattcattataacaaaggggcaataatcctgtcaattgtatttctaaattttcccccaaattctaagcagagtatgtaaattggaagttaacttatgcacgcttaactatcttaacaagctttgagtgcaagagattgaagagttcaaatctgaccaaaatgttgatgttggatg

SEQ ID NO: 1146 - DNA, 550 bp, Homo sapiens
  misc_feature 456: n = A,T,C or G
cggagcttgaggaaaccgcagataagtttttttctctttgaaagatagagattaatacaactacttaaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaagggactacggagccccgaattaataccaatagaagggcaatgcttttagattaaaatgaaggtgacttaaacagcttaaagtttagtttaaaagttgtaggtgattaaaataatttgaaggcgatcttttaaaaagagataaaaccgaaggtgattaaaagaccttgaaatccatgacgcanggagaattgcgtcatttaaagcctagttaacgcatttactaaacgcagacgaaaatggaaaggttaattgggagtggtaggatgaaacaatttg

SEQ ID NO: 1147 - DNA, 487 bp, Homo sapiens
ccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcag

SEQ ID NO: 1148 - DNA, 528 bp, Homo sapiens
gagagaaggctagaggttttaggaaaaacaagttttgccttattttcagtactgagtgttcagcaggacaagacaggaacgttctgtagcaagcacctagtcagttccattagccctcaggcaaggtggggagatgtaggaaggaaaagcaaacattctgcctcctagatacagtccaccaccatggacaaggcacgaggaaaagaagagacacatacagagactgtttgggatttttctctctctgttttcaccacgcagggaaagcaatgctaaaagtagtttctactttgggcaggaagcatgaagtgttgggtaaggccacggttctgtggccatctaatacgccagcgaggagctactgctgtccatgagctcagcagctgggcactggcacagacagatttttacaaaacccaaagccagagagagggagaatgtgttcctggataggggattaagaacaaagcacgtgggaaatgacaatgtgccttgtttgttctatttctttttttttattttatttct

SEQ ID NO: 1149 - DNA, 518 bp, Homo sapiens
ttttttttttttttttttttttttggggtcactaatttggtagtttataaaaatgctggaaatgaaattgtgtctagactaaattggggagtatgttctattttaaatatttagtttgaaggtcattctcacttttttgcctgattctttcagcgtcaactggcactggcttctgtgggtataagctgctgacttatttgtcaggcagctggaggcaaacgtcactgacaagattcagttatgttctcctctgcccgaagtccctgtcagctacataaagatgggaggttttctttacactgtcaggtgattgcagaccctgttttttcaaatatcagatgtcgacaatggcagcatcagctcctaggagccaactctgaatctgtgggcaatttacagagtaattgatttatacatctctttcgacagagcttcttttgtaaatcttgtaaatcttcacttgctggcatatctcggttctctgggtgaccctgcctatgctgacccttgtgcttatg

SEQ ID NO: 1150 - DNA, 456 bp, Homo sapiens
tttttttttttttttttttttttaaccatcaaattcacagctatttttcgcttttagtgtgctcacagaaaattagaacaccttaagcaggagtttaatagcattttttgtaagcaaagttacattccatctctaagtcaaattggtcaaagcttctccagtatttacaaaacatgatagacaagatgctacacaaaaccattgcatctgaagattttgttttcctttattctcaaagacgactggaaaagaaagcattatctgctgtaatcaaaaacataccacagtataaacagttaccattccacttatcacagcttggttgagtttagaattagtgttttaaaaagtccaagatgactgcagttttacaaaaatgggcagggtggaaagttgcaaacttcatgtgcttctggatatcaagatttgtttttatacaatagtcacagttaaaaa

SEQ ID NO: 1151 - DNA, 486 bp, Homo sapiens
ttttttttttttttttttttttttatcgagcgtgtctatttattgttgctgccaccctggaggagccccagtttcttctgtagctttcttttctgggggatcttcctggctctgcccctccattcccagcctctcactccccatcttgcacttttgctagggttggaggcgctttcctggtagcccctcagagactcagtcagcgggaataagtcctaggggtggggggtgtggcaagccggcctggatcctgtcctgggtcctccttcctccgcagtcccgtctctattgctgggtgtagtgtccatggtctggcctcatctccagctctgtctcagcgccgtgcccctcgcttcttcctctctgaattctgcagcttggtcaccagtttcctctcgtgcccgccagggctggggcggttggtgttggcagcagcttctctcttggtgcgacctttccggcctccacctccgaggtaggaatggg

SEQ ID NO: 1152 - DNA, 609 bp, Homo sapiens
tttttttttttttttctttttttcctgcaaaaaatttcatgtatactgagtaacaacctttgatcgatttattaattagaagctatttataccagtagaaaaatacccacaaacaattaaaattataagactatttttaaattcataaaaatggtactgtactgggtgtgactacatttccagtttttggtgtctcatgtgatacagaatcaggaggacttacatggctggaggggaggggagctgttttcctaatttgttactatttaaaaatggttaagggtggccacatcttgggggcttctcctttaatgtaaagtcccttttggaatatcacttaaaatctgggacaggtcaaatcagctgctactctacacgaccgtgtctgcagtacaggcgtggtgagaagacctatacctcactcggcagagtctcacctatgctgttcgcagcaacgcatcggccgcaggcacagagcgccatggccagagcccaccagggcagccgcctcgcaccacaaccaagggcctcacagcgcgcaatcaaaggtctggggctcactcaacgctgcggtcggagggtcggggcgccttgtctgggcaattttct

SEQ ID NO: 1153 - DNA, 619 bp, Homo sapiens
tcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacaaatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttct

SEQ ID NO: 1154 - DNA, 602 bp, Homo sapiens
gtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcggtgccttcagcccaccagcaggagcttggagtttgcgagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccatgggttctgctgagtaggtggagctcattgctttctccaagcttggaactgttttgaaagataacacagagggaaagggagagccacctggtacttggccaccctgcctcctctgttctgaaattccatccccctcagcttaggggaatgcacctttttccctttccttctcacttttgcatgtttttactgatcattcgatatg

SEQ ID NO: 1155 - DNA, 629 bp, Homo sapiens
gctcaggcaatccacccgccttggcctcccaaagtgctaggattacaggtatgagccaccacacccagctattttttctttcgttttttaattttaaagttggggggggtctcaatttgttatcctggctgatctcgaactcccggacttaagcgatcctctggctccaagcccactaccagtctcaggtttctttactaaaagatcactacctttttttctcttgtctgctgccatgtgagatgtggctttcaccttccgccatgattgtgaggccttcccagccacgtggaactgtaagtccattaaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcatgccagtaactctgaaatctctcttaattcctgctgtccaggcagcagaatgccatggtttccccaagtaggtagctgctttagcagttaaagcccaaatgtctgttctgctgatc

SEQ ID NO: 1156 - DNA, 500 bp, Homo sapiens
gggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcccactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaagggaactatttattccaaatgagagtatgatggacagatattttagtatctcagtaatgtcctagtgtggcggtggttttcaatgtttcttcatgttaaaggtataagcctttcatttgttcaatggatgatgtttcagattttttttttttttaaaaa

SEQ ID NO: 1157 - DNA, 578 bp, Homo sapiens
aataagtatcaattggtcctcttcacagggaccttcaccagcactgaatattacttagtctcttaatttttgacaaatatttcagtatttatggatgatttattaatttttctaataattatccaaacttatttttatttctctgaatggttagaattgagtaagaccttctgaagatggatacttgaagtagagttatcagagataaagtagagcactttttaaaagttttttttaaatagaaatgttttattgaaattagttcaatttaagtcattcttaaaaaataaattggaatactgatacatagaaaaatctgatgagatttgggattaaggacttctgtttttaagagaactgaaactattgatatttatttggagcaaagatgaatattattaccatacacttttggttaaaatttaaaaattctgatttgaacttcttgcccacagtttcttcctgctctctcaaccctcccttcttaaagtcctttaactatatcctttagttcacttctcccaaaatgctttaaaggtttctcactgcctcatagagattaacaataatatcataat

SEQ ID NO: 1158 - DNA, 637 bp, Homo sapiens
taagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcccgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggcgctccaagcagtttgaagcccaatctgcaaggacatttctc

SEQ ID NO: 1159 - DNA, 504 bp, Homo sapiens
ctggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaatacatgccccagttcatg

SEQ ID NO: 1160 - DNA, 522 bp, Homo sapiens
gttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagcccgctccggaacttgtcatctccaacgacaaaaggagcttttgccactgactccggccgtgtcctgacacctccagaacgcaggtgctggcgcccgttctgcctgggaccccgggaacctctcctgccggaagccggac

SEQ ID NO: 1161 - DNA, 456 bp, Homo sapiens
agagcacctctgtgtttctctagggagtaacattcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattaggtcttgagggcagagccctcacgaatggggttaaggcccttataagaagagacatggggccaggtgcagtggctcacacctgtaatcccaacattttgagaggccgagaagggtggatcatgaggtcaggagatggagaccatcctggccaacatggtgaaacctcatctctactaaaaatacaaaaattagctgggcgtggtggtgcgtgcctgtagttccagctacttgggaggc

SEQ ID NO: 1162 - DNA, 530 bp, Homo sapiens
gggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctggtgtgcacaggcgctcgtgaggctgccttccggaacattaagaccattgctgagtgcctggcagatgagctcatcaatgct

SEQ ID NO: 1163 - DNA, 612 bp, Homo sapiens
tacggccgggacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgtccaagctcagttcaatgagcaaatctccatactgtttctttctttttttttcattactgtgttcaattatctttatcataaacattttacatgcagctatttcaaagtgtgctggattaattaggatcatccctttggttaataaataaatgggtttgtgctaatatatcttgtatgcattctttaaaccttacaggaaattagtgatgagtttt

SEQ ID NO: 1164 - DNA, 242 bp, Homo sapiens
cggcgtctctggccctttcttattctttggctcctcatccaccgtgatgagaagcgctgctgaggccacggcacactgcttggcttgggtggcggggtcatggccagttggtgtcatcagcaacgagaaaaagcacaggttagctccccattagatggaaaagtgtaaggactgataagggctgcatcctcagcagtgtacagagtcccccgcgctctgaggttggagagaaagaacagacc

SEQ ID NO: 1165 - DNA, 459 bp, Homo sapiens
ttatctaacgtttctaacaggggtgttaatgatattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattatcgttgttgccagtgaaaaaaactcaaagaaggaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttt

SEQ ID NO: 1166 - DNA, 632 bp, Homo sapiens
cggactaagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacactgtgactgtctctccagatggatccctctgtgcttctggagacaaggatggccaggccatgttatgggatctcaacgaaggcaaacacctttacacgctagatgggtggggacatcatcaacgccctgtgcttcagccctaa

SEQ ID NO: 1167 - DNA, 653 bp, Homo sapiens
tgtccgacaaccctggcgtccatgagcctggtgagcctgatttaaatacattgggaatatgcatgggaatgaggctgttggacgagaactgctcattttcttggcccagtacctatgcaacggataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtag

SEQ ID NO: 1168 - DNA, 566 bp, Homo sapiens
atgaatttataaatctggatttgccttgtgtccttctgagttttcaaaggcaagtattcaacagtccctgtgtgatgactgacagggttatttgccccatccacatccaccttcggaatacattaacttcctttgtaatttatttgaaagtagtgttaaactcattcagatcattcagttggattttcccaatgaagaggaaaaggaaagtagttattcctagctccatttcttattttccaccaaatttaattgaagggcattaattagatgtcttcaccctgaatttagactttgctctgtgttctcccggtaactgtcagacaaaaagtttattggctctgaggaactgagaaatgttgggaacctggtttctgctgtacacaggaaagatttgtaagtgagctctctctttgaaaacaggacccaggctgggcacagcagctcatgcctgtaatcctagtattataggaggcagaggctcgggaggattgcttgagcccaggagttcaagatcagcctaggcaacatagggagaccctatccctacaaaaaatttctgaaaa

SEQ ID NO: 1169 - DNA, 579 bp, Homo sapiens
cagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagggaaagagaaagccaagatccactaccggaagaagaaatagctcatgaggctacggaaacaggccgagaagaacgtggaga

SEQ ID NO: 1170 - DNA, 619 bp, Homo sapiens
tcaggcagcacttccctgccactcctctgctcgattatgcactggaagtagagaagataccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatatttttttataagcatagaaataaaaaccaagccaatatttgtgactttgctctgctacctgctgtatttattatatggaagcatctaagtactgtcaggatg

SEQ ID NO: 1171 - DNA, 611 bp, Homo sapiens
acaaaatataaattggatctagaagaagggcaatgcaggcaatggaaaaatagtagaaatccctttaaggttagttggtaaaatcaggtaagtttatttataatttgctttcatttatttcactgcaaattatattttggatatatatatattgtgcttcctctgcctgtcttacagcaattcgccttgcagagttctaggaaaaaggtggcatgtgtttttactttcaaatatttaaatttccatcattctaacaaaatcgatttttcagagtaatgattctcactgtggagtcatttgattattaagacccgttggcataagattacatcctctgactataaaaatcctggaagaaaacctaggaaatattcgtctggacattgcacttggcaatgaatttatgggtaagtcctcaaaagcaattgccagaaaaatgaaaattgacaagcgtgatttaattaaactaaagagctgcttctgcacagcatgagaaactctcaagggggattgaacagacagcctacagagtggaagaaaatattcacactatgcatacagcaaaggcctattatccagaatctataagagacttagacaaatcaagaagc

SEQ ID NO: 1172 - DNA, 442 bp, Homo sapiens
ggcagccggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcggctctttggcctgaaagtgggaatggt

SEQ ID NO: 1173 - DNA, 517 bp, Homo sapiens
gtacaaggtattctccaagttctacctgacgtaccccaccaaaagaaacgaattccattttaacatttattcattcaccttcacctggtggtgatcctcaggagcagagactgttatgaattctggcgtggcttatgaaattaaaagttgccatcaaagccattttcttttaatttcacaaacatcaggcaatttccagggttggtctagagtcttgccactaaatattgatcactcgtttaaggactttccactccattgcaactgatgccactatatttgcctagcaacttgcagctacttccttttcaaagcctcatgtatctcccagacccttctcttgaagtccaataacaagaccaagtaagaatgtttcaacaatgcgttggcaagagatgtgagatgacaacaggaacatacaagatactgtgaatctagatgttctgacctaaaggtgtagtctacatagccccagcttggggtccaatccatctgtccctggcatgtgccttcacgt

SEQ ID NO: 1174 - DNA, 616 bp, Homo sapiens
tgcccgccgggactcgggctgccggccgacaaaggacggtcctcgggggttctgaagtctgacccggccagtgggaaagccacctgcatcacaaagcgaggggcacacctgaaccggggctggcgggaagagaaacagggaaaattgaccaagagattcacaaatacaacaccccaggattcactggttgcctctccagagtccagttcaaccagatcgtccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgatgttcaccatcctgtgcaccctggtcttcctgatccggtacatgttccgccacaagggcacctaccataccaacgaagcaggggggcggagtcggcagagagcgcggacgccgccatcatgaacaacgaccccaacttcacagag

SEQ ID NO: 1175 - DNA, 619 bp, Homo sapiens
aaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttttgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggcttt

SEQ ID NO: 1176 - DNA, 617 bp, Homo sapiens
tggggataaagtgagactccggccagtgtgccagctggatgcatagaagtcccttggacgattcgtcttaaacggacgttattgcgcccccactatgagatgggagtatttagaggagcaggacccagtcctgcctgcgaggggcttaaggtggggtgcgtagaagcactgacagttatccagagctagggactgaatcggatccctcacgcagctctcatttactgctagatctttcaaagaatgctttatctcaatctagatctttcgaaaaatgctttatctcaatcttattgaaagggaaaccgcgtcgaagaagctgaataaattaacaggcaccatccccgcaaaaagggagacgtgataagaatggacaccagatctctttgaccctggagcttgagagtaattaagctcacagctttggggtagattctctgttcaattaccttctatgtgaccttgagcaagttatttactctttcttgcctcagttctatcctgtataaaaataaggattataattgtacatagtgcacatagtgtggtctctatattattaccagacacatagtgtggtgtctatatatgctgttattaccagacactataatata

SEQ ID NO: 1177 - DNA, 480 bp, Homo sapiens
taaccctgctgtcctttttattgtttttaattaatatttttgttttaattgatagcaaaatagtttatgggtttggaaacttgcatgaaaatattttagccccctcagatgttcctgcagtgctgaaattcatcctacggaagtgaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagaga

SEQ ID NO: 1178 - DNA, 336 bp, Homo sapiens
gtgagaacatctaccccgcagagctcgaggacttctttcacaccccccccaaggtgccggaagtgcaggtggtgggagtgaaggacgatcggatgggggaagagatttgtgcctgcattccgctgaaggacggggaggagaccacgggggaggagataaaagctttctgcaaagggaagatctctcacttcaagattccgaagtacatcgtgtttgtcacaaactaccccctcaccatttcaggaaagatcccgaaattcaaacttcgagagcagatggaacgacatctaaatctgtgaataaagcagcaggcctgtcctggccggttggcttgac

SEQ ID NO: 1179 - DNA, 269 bp, Homo sapiens
ggctgtgttggaagctggcttagctggtggggcagccttatttcaattaaaagggcattgactgggagcgggggtcctggagtttgttgcatttcctattgccctcaaaatgagaaaccaggaaaatagcagattggagccttccagaaggcagtaaatggctgtttttattgacaaaaggaaaacattttacctgcctctcactgatggcatctcactggcttaaaatgaaggcaggttgtagtaaaaaaaaaaagtctacatttttc

SEQ ID NO: 1180 - DNA, 617 bp, Homo sapiens
atgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtag

SEQ ID NO: 1181 - DNA, 95 bp, Homo sapiens
agaagactgtcaccatctccaagccctgtggcaaactgaccaagcccaaacctcaagccgaatctaaaaaaaaaaaaaaaaaaaaaaaaaaaaaa

SEQ ID NO: 1182 - DNA, 256 bp, Homo sapiens
gtagagacagactccggcagccctggacttgctagcccaaagaaggaggatgggggggggctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattaggggaggtggcttttgctttatagtttggctggggagcacttaattcttcc

SEQ ID NO: 1183 - DNA, 423 bp, Homo sapiens
tttttttttttttttttttttttttcttttttttttttttttttttttcccaagaccatcctttattgtagtattagttcatggtaactgcatgaaaaaacatttcaggaggaatttacaatttccagcttaaagaacttgcccaccaacataaccaatttatgaaagtcaattcattaaaaggtatagaacctcttgttgggcatgatggcaagggacaaagctacaacttggcctgtgcctttggaagctgaggcaggaggaccatctgagcccaggagcctgaaaccagcctgggcaacataaagaatccgtctcaacaaaaaaaaaattttagccaggtgtgctgtgagctgtagtcccagctacaaggtgggaggattgcttaggcctgggtgattgaggatgcaatgagctgtgatt

SEQ ID NO: 1184 - DNA, 374 bp, Homo sapiens
tttttttttttttttttttttgtcaaaatagtttattatgttcagaaaaatcacagtttgaggaaaccttaaacaataagtacacaagagatgccccatggggcattccatagcagagacagactcctgtatgttttattccagaggcattgcatggtgataataaaatgataggaaatagaggaaaatagatacaggaaaaggcaatagacagggaagccagctagatgttagagtacggagcaatcgaggaggcataaccacacttggggtggctatagggctggaaaacgctgaagatgactgctttcactgaggtcaaggattgtaatattgccagctttgtaaagtcattaaagcagaagtttcttcag

SEQ ID NO: 1185 - DNA, 100 bp, Homo sapiens
gaagtctctttaagaaaatagtttaaacaatttgttaaaaaattttccgtcttatttcatttctgtagcagttgatatctggctgtcctttttataatgc

SEQ ID NO: 1186 - DNA, 582 bp, Homo sapiens
tgacacacaattggggcactgaagatgatgagacccaaagttaccacaatggcaattcaaaccctcgaggattcggtcatattggaattgctgttcctgatgtatacagtgcttgtaaaaggtttgaaaaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatca

SEQ ID NO: 1187 - DNA, 396 bp, Homo sapiens
ccttctgctctacgagaactatgggcagtcggaaacgggactaatttgtgccacctactggggaatgaagatcaagccgggtttcatggggaaggccactccaccctacgacgtccaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggaaagatggatgaagagggctacatttgtttcctggggaggagtgatgacatcattaatgcctctgggtatcgcatcgggcctgcagaggttgaaagtgctttggtggagcaccc

SEQ ID NO: 1188 - DNA, 478 bp, Homo sapiens
ggaggagagcgtgagaggctacgactggtccccgcgcgacgcccggcgcagcccaaaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccgcttcgtgcgcctgatctccgccttccgc

SEQ ID NO: 1189 - DNA, 450 bp, Homo sapiens
tttttttttttttttttttttttttgcggcttggaatctattttatgccaccagttggtcctcatcagataaaatttccttaggagtgcagagggctcattgcgaaaataaaaataataaaaataaatcaaacttcctaaaagcaaaagattgaaaaccactaacagtccaggtgcctcgttttatagaaaaacaggcccagggaactactagggcttatccaaatgtacagtttgaggcagagttacgaatggaacccagggcctcctggcgctgtccagagtggagttccttaggacccctgcaagccagccaagtccaaatctttgggccggggcctggagtccgccctactagttacctcctctcctctcggggtgactgaagctcgtggtgcaaagctaccatctcctgtcaatgggggcccctgggcctttctcattctgcccc

SEQ ID NO: 1190 - DNA, 602 bp, Homo sapiens
atgtaacagaatacctagctattactttagcagaaagtagagataagggaaaagaactgtaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaagggccaaactttaggtaatagcattggactgagatttgtaaactttccaaccttccaggaaatgccccagaagcaacagaattcacagacggaagcaaaatacagggcactacagttcagacaatacaacaagagcgtccacgaggttaatctaaagggagcatgtttcacagtggctggactaccgagagcttggactacacaatacagtattatagac

SEQ ID NO: 1191 - DNA, 622 bp, Homo sapiens
acttaagattttttcaatgtaagaaaaatgcaatgaaataatagctgcaaatacccactactaacaattgcttggccttcttatatagacctcccgaggttctcatcttttacatttcaggagtagaatcagttaaaaactaatctttatatgtaagggatgagagagagaaagaggagggtatgtgtatgcacacatgtgtgtgtgtgtggtgggtagtaattttaattcaatgatttactagagttcgatgtcgtttgctgataaatgaagcaggaggaagagccaggtttggaggggacgagagaatgagttccatttgtctcatatagaagttgaagtaactgagtgatgatgggtagagatgtccctcaggggtagccacagtattttatttactttttattcaccacatgcagcaaggagctttgttctccaaaatgctgtcaattatttttctaaattacaggtttgattgcttcactgtattttcatgtctcattactacctttacgcttaaaaccagaaactgtgccacagcgttaaagattctgctaacttttaaaatacagaactctggagatgccataattagattgcagatttatgagtcttctggata

SEQ ID NO: 1192 - DNA, 384 bp, Homo sapiens
ttttttttttttttttttttttttttggagcaacatcattccccccattttcaaccaccatccctccctggtactaaagggaatgctgcaaggaggaaaagaagggagaagggaagcagaggtggtggagaaggatctgaaatgctacttcctacacgctttttttttcttggaggtggaaggagtggaggatgatgatgaaaattcaagcagcatgtactagacggcagagcagcatgagctacatccacactgtgcaaagtccttaatgtgcacacctagaggagcaagggccctgttctcagttaacagttgtcaagagaaaaagacaggttgtcctgctgggttaactggcaaggaaagttttagggactatgatggctc

SEQ ID NO: 1193 - DNA, 497 bp, Homo sapiens
aaggccaagcaaggttacgttatatataggattcgtgttcgccgtggtggccgaaaacgcccagttcctaagggtgcaacttacggcaagcctgtccatcatggtgttaaccagctaaagtttgctcaaagccttcagtccgttgcagaggagcgagctggacgccactgtggggctctgagagtcctgaattcttactgggttggtgaagattccacattcaaattttttgaggttatcctcattgatccattccataaagctatcagaagaaatcctgacacccagtggatcaccaaaccagtccacaagcacagggagatgcgtgggctgacatctgcaggccgaaagagccgcggccttggaaagggccacaagttccaccacactattggtggctctcgccgggcagcttggagaaggcgcaatactctccagctccaccgttaccgctaatataagtaaagtttgtaaaattcatacttaataaacaattt

SEQ ID NO: 1194 - DNA, 430 bp, Homo sapiens
gcttttgtgacaatttaaaaaagttagctcatgtatatacacggtgggggtgagaactgacagcttgctcagatctaggagaacgcagagtgaaatgctatcattcaaccatgtcagtttgctgcccccggggcatttcaaaccaaacctttctacgggagattctgtccatctgtcagcctgctgtggtcacaggtctccgttcctcagtgtgaacggggactccgggctgcagcgtgccacccgcctcctgcatgtgtggagtagatggtttcgaactccgtggcagaagggaaatttaagaggccaccggggctccatctctttgtacggccatgtgactgggaagcaaatcaaaggaagccgagttttaacctgttgattcttaagagcgatgaagggggacaggagagtctgtggcctgctgtgc

SEQ ID NO: 1195 - DNA, 352 bp, Homo sapiens
gtgtgaggtccagggttgctaggaaaagaaatcagcagacacaggtgtagaccagagtgtttcttaaatggtgtaattttgccctctctgtgtcctggggaatactggccatgcctggagacatatcactcaatttctctgaggacacagataggatggggtgtctgtgttatttgtgggatacagagatgaaagaggggtgggatccacactgagagagtggagagtgacatgtgctggacactgtccatgaagcactgagcagaagctgggggcacaacgcaccagacactcacagcaaggatggagctgaaaacatgacccactctgtcctggaggcactgggaagcct

SEQ ID NO: 1196 - DNA, 438 bp, Homo sapiens
aagctcatctaccttcagcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatg

SEQ ID NO: 1197 - DNA, 430 bp, Homo sapiens
aagaatgagagtgcccggcagcagctcgagcggcagaacaaggagctccggagcaagctccacgagatggagggggccgtcaagtccaagttcaaatccaccatcgcggcgctggaggccaagattgtacagctagaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaagcagctggaggaggcagaggaggagtcccagcgcatcaacgccaaccgcaggaagctgcagcgggagctggatgaggccacggagagcaacgaggccatgggccgcgaggtgaacgcactca

SEQ ID NO: 1198 - DNA, 585 bp, Homo sapiens
tacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcattttctttaaagatgccctaagtgttgaagaagagtttgcaaatgcaacaaaatatttaattaccggttgttaaaactggtttagcacaatttatattttccctctcttgcctttcttatttgcaataaaaggtattga

SEQ ID NO: 1199 - DNA, 568 bp, Homo sapiens
gcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgagaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctg

SEQ ID NO: 1200 - DNA, 443 bp, Homo sapiens
atagcctgaggtcaggagtttgagaccagcccggccaaaatggcgaaaccccgtctctaaaaacacaaaaattagccgggtgtggtggtgcacacctgtaatcccagccactcgggaggctgaggcaagagaactgtctggaacccaggaggcagagctttgcagcgagccaagatcatgccactgcacttcagcctgggcaacagagcgagactctgtctcaaaaaataataaaacaaaacacagaatataagttccataaggaaggagatgtttttctgtcatatgcacctcctgtagccaggactgtatttcagtgagtatctgtagggtggacagatgggtggatgtgggtgactgattctagaagagtaataaatgtgtcagaccagctgagaaagtcttttttttttttgaaacaaaattttactttttttgcccag

SEQ ID NO: 1201 - DNA, 575 bp, Homo sapiens
agctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcata

SEQ ID NO: 1202 - DNA, 67 bp, Homo sapiens
ggagaattgcgtcatttaaagcctagttaacgcatttactaaacgcagacgaaaatggaaagattaa

SEQ ID NO: 1203 - DNA, 564 bp, Homo sapiens
ctgagtgtgaagtcagcagagctgtgactgtggcaacctaatattgtgacctccatcttgaagagtctgcacatttaagctggggatagcgtttcttgacttctgtgaggctccggcaggggaagaggaagcactttaatacatatgcctctcttttacaaaaaagaaaaaaaaatcatcgtaggccctaacatgtaccatgttgacaaaaatgccagatcaaatggatttgagaaataagcccaattcaaggctggctcagccctccacggggcctcccagggaaaggaattcctttatgttcttggaagcccttttctagaaaagccattccattcatacctttgtagagcagtgggctgggtgtggagggcagcgcggagggtatctgcaagagcctgtattttccgcctcccttgcccccactccttttatccttttaaaagtcctatcagccctgccttcgtcccttccgccctaagccctaagagtggggggaggtttaatacggccaatggatcttgtataaagtctacgtaagttttaatttaccagagctataag

SEQ ID NO: 1204 - DNA, 546 bp, Homo sapiens
tggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaagagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgac

SEQ ID NO: 1205 - DNA, 602 bp, Homo sapiens
ttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctgccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaggaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatg

SEQ ID NO: 1206 - DNA, 534 bp, Homo sapiens
attttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattatt

SEQ ID NO: 1207 - DNA, 557 bp, Homo sapiens
tggcttcttgaaaagttcgctctgccagaaaccacctaggccacgttagctgcttccttgagctccccagagtcggtttccacattgtgaggtggagggctggtgtggaggtctcatggggtgcggtgcttgggagacagccaggcccaggtggctgctgcttcctgctaagtgggggaggtgagacagatctggaaagccgtctccctcagatggtttcatttaatgctttatactgccgagtctgggagcttgttttggtttgggggcagccatcctccaccagaaagggggagctccttccgctgcggctccagatagatggggatgccgggctccaggccgaccagcacttgggatctgatgggacacggccagtgcctaggggtgccgagtccaaggcctcccactgggagtcatcgctgagaagatgccaatgtttcatccaccggctgcacaggcacaaactcccccacccaggacggctgtgatgaggtggccctccctgtcaaccctggtccctggagtccccaacacctggggccctggtggggctg

SEQ ID NO: 1208 - DNA, 595 bp, Homo sapiens
tgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgctgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcag

SEQ ID NO: 1209 - DNA, 639 bp, Homo sapiens
aagcctacccggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgcccggtctacgtgcagctggagagggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcattgtctgaaggaggaggagctggaacggaagcccagcctgtcactgacgttgaccctgggcgaggctgaccacaaccactatggatacccgcact

SEQ ID NO: 1210 - DNA, 621 bp, Homo sapiens
tgagggtccccgctcagctcctggggctcctgctactctggctccgaggtgccagatgtgacatccagatgacccagtctccatcctccctgtctgcatctgttggagacagagtcaccatcgcttgccgggcaagtcagagcattggcatctatttaaattggtatcaacaaaaaccagggaaagcccctaaactcctgatctatgattcatccagattgcaaagtggggtcccatcaaggttcagtggcagtggaggtgggacacacttcactctcaccatcagcagtctgcaacctgaagatttagcaacttactactgtcaacaagggtacagtacacctggcaccttcggccaagggacacgactggaaattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggaggggtgtcacagagcaggacagcaaggacagcacctacagcctcagcagcaccctgacgctgagcaaagcagactacgag

SEQ ID NO: 1211 - DNA, 583 bp, Homo sapiens
aagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagcgtgataaggctgctgccacctgttttgctagaaacaagacgacctacaataaaaagtaccagtactattccaataaacactacagagggagcacccctcgttgctgagtc

SEQ ID NO: 1212 - DNA, 662 bp, Homo sapiens
tttcctccctaaatcttttagcaagtcctcattgtctattcttctttcaaaaaccatttatttgaaaatactattaaaatagaaaattttccacattcttacttcttaaaaattaatgtgttttaagtctctcctactccacttccatcccatgcctctttactcaatggatgcaattattcttctacatgttccttctggccatgtgtagctttgtcattttaattttaatctatttggaccctgtgttatctgggatgaggtagagtgatatttttattttctcaggtaattatttgcctaatgcctgtttccaaataatccaccatttccttacaatttaaaaatgctccagcatgtttttaatagctacacatatttgacacattttctggagaatttctgttttatttgtctatttcattattcttgtatcattatcatattatctcagtagctttgtggcaagtattaagatctactatgccaaatgtctattcactgtaccatttttcagaaaattctttttcaatcatctcatatttattcactcctgtagaatttaaaatcaacttatctagcctaacattaaacctcacaccctagaacaacaacatgtcgtagtaattctgactaaaattgctggaaatttatagatgaat

SEQ ID NO: 1213 - DNA, 598 bp, Homo sapiens
agtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttgg

SEQ ID NO: 1214 - DNA, 600 bp, Homo sapiens
cagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggatacccagcttggatgtctacagaaagctaatagagcttaactac

SEQ ID NO: 1215 - DNA, 548 bp, Homo sapiens
atgatataaacattttttagtgtcctatagaggaaaaagtgacataatgtcttatagaactataatattaagaaagatacccagaaaagctttagaaatctaaaatctcttcaggatgtttatactattttaattaataaccagttattagagaatttcaaagtatatgcgatgagataattgcgaggtttgagtgtctagtgactaaaacaactttgattgtgtttagtatattgcaacatgagaaaacagatgtgacagccatttggtgaagtttaacattaggagcattccgaaaaactgaaaagctttgtatatctgcatactttatattatttgaattatgtccaaaatattcctaatatctttatttttctatatgtgtggctaatatctaaattacattttcttaatacataattcaaaaattgtgaaagtttattaaaatgtaatgctcatgaaaacttgttttcatgaaaggttatggaagaattagaaaaggtaaaacaagaaatggaagaaaagggcagcagcatgactgatggtgc

SEQ ID NO: 1216 - DNA, 449 bp, Homo sapiens
agccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtctgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatgg

SEQ ID NO: 1217 - DNA, 463 bp, Homo sapiens
aattggaaaatcgcggataattctagtcttactatactacctaatatagcatcctactatacacttatgttaagtttcttgatagcatttatcacggccgagcgcagtggctcatgcctgtaatcctagcgctttgggaggccgaggtgggtggatcacctgaggtagggagttcaagaccagcctggccaacacggctaagccctgtctctgctggaaatacaaaaattaaccaggcatgttgagcgcctgtagttccagctactcggaaggctggggcggggggattgcttgaacccaggtggcagaggttgtagtgagccgagatcatgccactgcactccagcagtggaaacagagtgagactgtcttaaaaacaaacaaacaaaacaacaacaacagcaacaaaaagcatttattatataaatactggcttatttatttatttgttttcctgtttact

SEQ ID NO: 1218 - DNA, 461 bp, Homo sapiens
gacatcagccagaacaagcgagccgtgaggcggcggcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtccctggggctggagac

SEQ ID NO: 1219 - DNA, 635 bp, Homo sapiens
atatgatgacataagacttcactccaacttccagttcaaattcccatcagatctaggtatagtttgtttcttatctttgattttttgaggatatattgtataagatatagcctcctttagtgctaatttgaatatattttcacttgtttcatccaaaatagccttagtgagacttgttactttccacgaaaaacattttcatttttaatgtaccttttcagtgtggcttttccaatgtatttatctgttgaaattgtaaaggtgctttatgatctagcccaattcctatttgtgactttttagaaatttcaccccaaattagtattgtttttacacacctttgttcttagtgcacttcttattctattcaaagccttagacattctacttttgatattttaagttctgtatctatttccataatactactttgaaccatatcaaattgtcccgggtattaatattgtacaaatcgccgatacttgactatttttgacttactaaaatggcaatttcatgcagatcaacttattatattggaagaaaatttactgacagagaggtatcttaatgatctctacaccctgaatatctgattaatggtaggtcttggtatattttggtgaaattaaata

SEQ ID NO: 1220 - DNA, 539 bp, Homo sapiens
tacggccgggattgtattagctattataggtaatctagagatgatttaaagtgtatggtaggatgtgcacaggttatatgcaaatactacaccattttctataagggacttgaacatcatggactttagtaccctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggct

SEQ ID NO: 1221 - DNA, 519 bp, Homo sapiens
aggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccataacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcctcacacactgaattttcagtattttatctcaagtagatatagacactaaccttgatagtgatacgttagagggttcctattcttccattgtacgataatgtc

SEQ ID NO: 1222 - DNA, 542 bp, Homo sapiens
ctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcccgacacccagtggatcaccaaaccagtccacaagcacagggagatgcgtgggctgacatctgcaggccga

SEQ ID NO: 1223 - DNA, 547 bp, Homo sapiens
cattgagaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaattgattccaacacaaaactccttcccctttttaaaatgatttctgttctaatgccatagatcaaaggcctcagaaaccattgtgtgtttcctctttgaagcaatgacgagcactttactttcacggtggtttttgttttttcttattgctgtggaacctcttttggaggacgttaaaggcgtgt

SEQ ID NO: 1224 - DNA, 624 bp, Homo sapiens
ctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccgcgaaagggctcaagtgctgtggcttcaccaactatacggattttgaggactcaccctacttcaaagagaacagtgcctttccccccattctgttgcatgacaacgtcaccaacacagccaatgaaacctgcaccaagca

SEQ ID NO: 1225 - DNA, 599 bp, Homo sapiens
ctgacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggctaagactacagctaacctggcagtagatgtgattgcttcaagctttggtcagacaagagaaggagggcatattgtctatgaccaacttcctactcccagttcaccagatgaatcagagaatcaagcacgtgtgagaatttaggagacactgtgcactgacatgtttcacaacaggcattccagaattatgaggcattgaggggatagatgaatctaaatggttgtctgggtcaatactgccttaatgagaacatttacacattctcacaattgtaaagtttcccctc

SEQ ID NO: 1226 - DNA, 650 bp, Homo sapiens
  misc_feature 582: n = A,T,C or G
ccactgctcaagtgggttgatcagtgcccccgcccgggtccactggaagctggagcggtctgtcactttagcttgcaagtctcaggggccctgaaaacgcacttcccagtacttactgatcattgctgatcaataccagaccacttaccaggcactttgcctctagtgagtatacattgctccagctcctcaaagccttaaaataccgttcgaagtcaagaagctaagttacacagcaatagggttagaattgttttttttcctaagggaaatgaatatatttcacaggaatcagacaaggcttctctagctggtgttgataactcacatattttctttccacagccctttattacagtgtatatactttcaacaaaaattgttgctaagccctgcgctaggtgctggagatgtaaagattaataaaagacagttccaaacctgaaggaacctcacagactattgagaaggagagaagcaaacataactgagtatagttgtgaactgctataactgtacaaattgctgtgggaccacttaaaatatataaatacataccctttacattctgcttggagggtnaggagtgtcttataacatggcgcttttaacattctttgctaaataaaatgtaaagataacaataaaca

SEQ ID NO: 1227 - DNA, 546 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgc

SEQ ID NO: 1228 - DNA, 634 bp, Homo sapiens
tcaccaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatggttgaagatcagaagagagacaccat

SEQ ID NO: 1229 - DNA, 568 bp, Homo sapiens
aataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaag

SEQ ID NO: 1230 - DNA, 518 bp, Homo sapiens
tggtccttctgggggtcaggcctttgacagcttgcgctggtggcaggtttgggagcagttgaggggcttcctgtgtgtcttttggagggggtgaccctggaagttggcactctggaagggagctgtttggccctagagttttggaaagggccctgaacctgttcggtccccctcggaaagggaagggagcagtggcttagtccctccctcctccattcgtgcaatgcctggggtaggggtagacctggagcgggtggactcatatccttggaattcgtcaggacagctgctccggggccttggccctcagtcggtctggggctgaggagtagggaagctgggaacttggggcagaggaagaagatgcgtttagaaagacctccattatgcaaactggagtccatttatgcaaactggtcacccttccagtagctccaaagagtggcagtggagtggcatcttgattgatttaacctcttctcaggggacctgggtctgcgagggaggatatggctgcg

SEQ ID NO: 1231 - DNA, 158 bp, Homo sapiens
tgaggacaagctaccattttgtcctcatccttacccccgatgacttgtcgagagatctgacctttcaggttttgatcctgtccttatctaggatgaggagcacgcactttgctgacgcgcatggtgaagtattgcgcctaggtcctggatcttcatct

SEQ ID NO: 1232 - DNA, 510 bp, Homo sapiens
tatatatgcatctgtggataatacattgttggttatcacattcggcagctttagtgcagtagcaatccctccaaatcccagtgacttaaccaaaaccatatacttgtcacttgactttgtgcattagcagcagcttcttatctaggcagctctgcccaatatgtctcattgaaagctaaaaagtgctcattctgggcactaggctgaaggagcagcgcttatttgagatatatggtccttgtggcagacagaaaagagtaagatagctaaagaaaacaatcaatggctcttaaaacttctgcttggtagtgaagtgtgcacacacactcactttgcgtggaccaaatcaagtcacatggctgagcctgacggcaatgggcatgaatatttatcccttccattggaggcactgccaatcaaattgcagaaggtggggacatataatccttttaaaagaagggcaagtggccaggcatggtggctcatgcttgtaatcccagccctttggga

SEQ ID NO: 1233 - DNA, 528 bp, Homo sapiens
gtgccactgcactccagcctgggcaacagaacaaaactccatctcaaaaaataactaaataaaaataaatgtttgtgtgtgtgtataagtgtatgtgtgtatatactgcgctccagcctcagcgacagagtgagactgtatctcaagaaaaaaggttttgaaaaaggaaaaggaggtgttgcttcagccacatcttaaaggaggtaacacttgaccagaagggaaggggatctggatgttcttggtacagaaaccacaagttcatatgaacagaagtgtcaacagctgaaaaagtaaggggacaagtagtcccatgggactgcagccaaatgtacaaggttagcgaccagataagactctggacgggtcagcaggaggggccaggtgatggatgccagaccactgggtcctgggtacttaccacattgtgcttcctagtccccaagatgtggtcctcaaaaaagacgaaaagtcacggtcaaatgaatttgggggatgccaagttaaagctctcccaagcggggaaat

SEQ ID NO: 1234 - DNA, 604 bp, Homo sapiens
tacggccgggttcttctgatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggatgaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtgggtgtgtgccctgggcctgactgggggtctggtgggcatcattattggga

SEQ ID NO: 1235 - DNA, 264 bp, Homo sapiens
gtgaagaacagtacggtttggtgttgaatgcagtatataattcacagttgcagtccatactgtctgagtcagttcatgctgctagaacagaataccatagactgggtggcttttaaacaatagaaatttatttctcacgattctagaggctgggaaatccatcaaatcaccagcagattaagtgtctggtgagagtctacttaccgatttcataagcagccattttttctctgtgtcctcacgtggtggaagggacaagggacc

SEQ ID NO: 1236 - DNA, 601 bp, Homo sapiens
tacggccgggcccctgtgttggtcgtctatgatgatagcgagcggccctcagaaatccctgagcgattctctgggttccactctgggaacacggccaccctgaccatcagcagggtcgaggccggggatgaggccgagtattactgtcaggtgtgggatggtagtagtgttcctccctatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgtcataggttcccaactctaaccccacccacgggagcctggagctgcaggatcccaggggagggggtctctctcc

SEQ ID NO: 1237 - DNA, 519 bp, Homo sapiens
attaaagtgagtgagtgttctgaaagttgagtattagtctaaacattattcctgtacattaggcagcagttaaagaataggtaaaatactgctttctggttttagaaccatgtaaattaatagcagtttcacagcagtgacactgctcattctttatcttgttgcacttccactgatgttttagctgtgatttttaaataccttgtgcaatttaagtatgctttatatattgtgtttttattaatagtatataagatctgaagctgcaaatcaatttttatagcttataacaaaaacatttatttgttttaatccacagtaaacttggggagctatattccctggctttaaagaaattgattttgatttagtcgatttattaaacaatttttaaaatgcttatagttattttttctctagtattaattatatctttcaagatacagctgagaaagattaacatgcctattaaatttatttctccagtgactttgttaactttagctcatcataggaatg

SEQ ID NO: 1238 - DNA, 244 bp, Homo sapiens
gaggcagggttcaaactcaggaaatctagaccccagaagctcaggccctcagccacatctcttaaagaggcgcactctattccacaggctgtggcaggctggaccttccccaagcttctttctgaacatgggctcggctttctaaaaatggagccaccttgatcctccaaggagtggatctgaaccacatgcctgcctaacaactgactctgggccctcctggctttgcggttcatcagctctc

SEQ ID NO: 1239 - DNA, 313 bp, Homo sapiens
tttttttttttttttttttttgcaagtcttatgatttatttaacttgtggaacaaaaataaaccagattaaccacaaccatgccttactttatcaaatgtataagaagtaaatatgaatcttatatgacaaaatgtttcattcattataacaaatttccaataatcctgtcaattatatttctaaattttcccccaaattctaagcagagtatgtaaattggaagttaacttatgcacgcttaactatcttaacaagctttgagtgcaagagattgaagagttcaaatctgaccaagatgttgatgttggata

SEQ ID NO: 1240 - DNA, 247 bp, Homo sapiens
tttttttttttttttttttttttcaaatactgactttattgtcaaatgtggaaatattttgttaaacaatacagagatgatagtagtacttagggtaagcattaacaatattattcaaaatgttatatagagttcaactgtatacaatagcgcatttattaaagtgtgtccaaagcgcttataaataaagcatcttcgaggcaggcggctcacttgaggttaggaggaaagcaaactggccaacatg

SEQ ID NO: 1241 - DNA, 107 bp, Homo sapiens
gataacattctgagtatattggattagtcacagcagaatttactttagttagatgagttctacaaatttaaagctttgaaaagctactacttttacttctaatacat

SEQ ID NO: 1242 - DNA, 115 bp, Homo sapiens
gagggtgagtggcctgaggtagttacggcacttaaaactcccttgctaccgatctggaactcaagccccaagacatccccttagatgatctgaatacgcattcagggacagatct

SEQ ID NO: 1243 - DNA, 493 bp, Homo sapiens
tttttttttttttttttttttttggaaggtgctcaggtctttatttgctctctcaaattccaggaattgacttatttaattaatccatcaacctctcatagcaaatatttgagaaaacaaatttatattcagattcttattttcagtagggaagtaagaagttgcagctcagtgcacataaagttgagacagagatggagacatccagccccacctctctggaacaggaaagatgactggggaggaaacacaagtcagcatgggaacaggggtcacggtggacacgggggtgggctgtctctccgcctcctcacattatgctaacagggacgcagacacattcaggtgtctttgcagaaagagatgccagaggctcttgaagtcacaaaggggaggcgtgaagaaatcctgcatctcagtccctcacaagacagctgtctcaggcttttcaagctgtgagagacacatcagagccctgggcactgtcgctgca

SEQ ID NO: 1244 - DNA, 457 bp, Homo sapiens
catgccggaaaattggtcgcgattgtagatgttattgatcagaacagggctttggtcgatggaccttgcactcaagtgaggagacaggccatgccttccaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctaaagttccagcaaaaaaagatcaccgccgcgagt

SEQ ID NO: 1245 - DNA, 578 bp, Homo sapiens
tcatctcaaaaactcactttaaacatttactgcttccaaggctctttgcttctaacccagcatttgatatggtattattggatggtaatatttttcccatctaaacaaagagctccttgagggcaggggctgtatcttttgtttctatatcctcaaccctaagataaattgcgtataaagcaagaatttgcatgtaaaatatttctttagtttcatgttttactgaaagttcaacctccaacatgcaacaaaaattgctattaaaactcacactgcccatctgaaaaaattttccaacatttatttatttaaaatctatttatatttaattttcccagattgttaccaaataatcagttcataggactaccgaaactaaattaacagaattcctatctgcattcttaataactccatggttttaagtgtgtaaaactgccgtgctgattatgccaaagctctacatacttaaagagacacactggacagtccacaatacagcttcaattgataaaaaacagtttagaatttgcttaattccaattgagaaaactctgctcttaatgacttactgacct

SEQ ID NO: 1246 - DNA, 98 bp, Homo sapiens
ggaaggaacaaaagaactcatggcttctatatggataatctgaacattcaaagctttgacatctacaacattggccactttttcataatccaaacttg

SEQ ID NO: 1247 - DNA, 83 bp, Homo sapiens
gaatggacatagtaagttattctaccgtaacaagggacttactaaagaaaatgctaaaggccgggcacagtggctcacacctg

SEQ ID NO: 1248 - DNA, 472 bp, Homo sapiens
catgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctaaagttccagcaaaaaagatcaccgccgcgagtaaaaaggctc

SEQ ID NO: 1249 - DNA, 503 bp, Homo sapiens
gtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagaaagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcggaaaatgggggtcccttactgcattatcaaggg

SEQ ID NO: 1250 - DNA, 617 bp, Homo sapiens
tttttttttttttttttttttggagatgaaaactatcatttatttcaattgaatttagtttcattaaaaaattctatgataacattaaaacagaaacaggacgtttatatgactgtctttaacctcaaaagtccaaataaacatatagacattttgaatatagctatcgttttaacaaacctcattatgatcactgttgcaatttcagtcacctaaaatacgaaccatgactattaataaacatttactgtgtgtggtttgttggactgaacattgaccatacgtgtatttctaagtactaggagttgaacagctactacggtcaatgtattttggcagttagctgtgtgtggtgtgtgctttttaaggcttcactcaataaaacatctgttgctctctgctgatgagcaaaaagcttgctatacgaaggacaaatatatgtatacaaacaaatacacacgtgtgcatgtctatatacatatatgcaatttcagggaggtgacaccttattctgagaggtcatgagactccacttcaaaccataatagtaaaacctttagtaaactgaactcaacatattacagccaccatcatcaggaaaaattaaagactcatag

SEQ ID NO: 1251 - DNA, 202 bp, Homo sapiens
ggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccg

SEQ ID NO: 1252 - DNA, 568 bp, Homo sapiens
ttttttttttttttttttttttttttcgagacagagtctcactctgtcgcccaggctggagtgcaatggcgccatctcacctcactgtaagctccgcctcccgggttcatgccattctcccacctcagcctcccgagtagctgggactacaggcgcctgccaccatgcctggctaattttttgttttcgtatttttagtacagacggggtttcaccgtgttagccaggatggtctccatctcctgacctcgtggtccgcccgcctaggcctcccaaagtactgggattacaggcgtgagccaccgcgcccggctggaacattgtatcttttacctgctaacgtgcccgtatttttctgtgagtcactgatatgactgacagtgagtttggagtttcctgtctgcgtgccaagtgtctttcagtgagccagggacagagatatgccacaccatagcagcctttattccaagcacacctcacaccaagctagggggcacttttatatttctgtttattttctgtttattttgtggaagtctcctatggccacatggctcgaaatgttaca

SEQ ID NO: 1253 - DNA, 604 bp, Homo sapiens
tttttttttttttttttgagacagagtctcgctctgttgccaggctggagtgcagtggcatgatctcggctcactgcaacctgcaacctccacctcccgggttcaggctattctcctgccttagcctcccaagtagctaggactacaggcacgtgccacctctcccagctaatttttttatttttagtagagacggggtttcccccatgttgggcaggatggtctcaatctcttgacctcgtgatctgcccgcctcggcctcccaaggtgctgggattacaggagtgagccatggtgcctgggcagcaagtaaccattttaaagaaatactctcaacgagttctttttttatggggtatttcagttgttaacaaagttaaaatacttattggaactaattctttgtattttattcgaggaagaagaatctataagattgacttactcattgttgactggttttttgaagctttactgggtatatggacagtttgggataaaaagcaaatcacttttcaaaagctgacttaaagtcacataaactttcaatacttcacctgcaaatctgcttcaacctcactacacacaaaagaaactgctatgc

SEQ ID NO: 1254 - DNA, 558 bp, Homo sapiens
tttttttttttttttttttttttcaaatatttatctaaccacatgtatatacaactttctaaacttgaagtctgaatttgaaatgacgaatctttaaaccaaaagatacatataccattgacagagacacctatctatacaaacctagcccacgggaggctacatctgtagcaataaggatgggtgcctttccagaacggaactcattaagtacccaatctctttctggttgactcttgtctccatggatacacatagctggccaaccatctctgcgcatccttcgagtcagatcatcacagcgtctctttgtctccacaaatattattgttttgttttccttttcagccattatttcttccattagttggatcaacttgtggtctttttcactttccatgcagacatccactatctggaggatgttgtggttggcactcaactccagattgcctacgttgatctgggtgtaatcacgaaggaaatcctctgcaagctgtcttacttcttttggccaggttgcactccacatcagtgtctgcctatcaggcctgattt

SEQ ID NO: 1255 - DNA, 554 bp, Homo sapiens
ccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcact

SEQ ID NO: 1256 - DNA, 639 bp, Homo sapiens
cagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccatctggacggtggccccctcagcctggcagcctctggacagagaggaaggaaggattggaaaagtccccgcagcacagcgacggtgggaagatgccttacgtctgatcttgatgggggcactggcctggagcctaggcccacctgcttctggggggttggggagcaggccagatggaggtggtggtgccaggaagaaatggagcgatgactgactgtggggtgggcccaggatttccacatcttggcgaagttgcccctgggaagggcagctgggggcagtggcgccagttcccttccatggtctcccggctggcaatgtggt

SEQ ID NO: 1257 - DNA, 646 bp, Homo sapiens
ggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctg

SEQ ID NO: 1258 - DNA, 616 bp, Homo sapiens
ttgaagccttggaaacttgggtggctgatattctccagaggcagaaaaatgttcccagccgagagaggccatctccagcaggtcctgagtgtcaggaattcagattctctgccccactcctgctggataggaggacacttccactagaacctgggcctggcccctttccagttttctgctgggagtccggattctggtgctttgctccgaagcagtgcccgtgggcctccgggcctggctcatcatcacagcttctctgctcagtgaggagaccatcattgtgctgcttttctgatgccttccatttgcctttttctccacttgggaaaaacaaaaaaagctagtatgctacatcctgaaaagttgttaacccttcaccaccacatacattgaaaaatcagttcctgccgggaagtaccactaaaggcatattgtaaactttttttctaattggaaaggtaaacttttttcccccataactatttttcgtgtgaaggaagtaactgacctcttgagtcagagatggcactcgagtttttccccatgggtcttgcctgctacactcctggccaccctttctgtggggcttgaccaaatggaccacactggccagcct

SEQ ID NO: 1259 - DNA, 534 bp, Homo sapiens
gggcactgctggtgggctgggctgagcctagaggtcagagtgggggtgtggtgaccagaatgtcagtgcagttggcagctgagggtgtttgtgtgacctgaggtcacccttgtaagaggctccctggggcctgcatggtacatcctcccctctcctgggggaacccagctggcccaggatttgtggattgcttagaaagatccttttgggcagcctgaagactggggagggttttcctccctcctccacctccacccacattccacttaccctttccctcctcatcccagttggtaacattcccacctgattagtgtggggagttgctgctgcagctgagttctggttttgcccagcaggatcacacacgtgcggccaggaggctggcaggtggaatcagggtgtgcaggggtgcagcccaagtccttttctgctggaaaatgggctgggtgacttcacttgcgtttttttggtatgtagtgggagtaggtccccattcttcccccttgccctttgctttggggtttctaccct

SEQ ID NO: 1260 - DNA, 641 bp, Homo sapiens
ctattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaacagggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgct

SEQ ID NO: 1261 - DNA, 443 bp, Homo sapiens
gggtgggcggatcacttgtgatcaggagttcaagaccagccttgcccacatggtgaaacctcatctctgctaaaaatgtaaaaattagccgggcatgactgtgggcatttgtaatctcaggtacttgggaggctgaggcaggagagttgcttgaacctgggaggcagaggttgcagtgagctttgtgccaccacactccagtctgggtgacagagtgagactccatctcaaaaaaaaaaaaaaaaaaaacccctaaataaggcccgaaaaagccaagggaaaaggggccagggtttcccccttttatccccaccttttaaaaacccaaattggggggaacccggaaaaccaagaatttaaaaaccacccgggcaaaatggaaaaaattttttttttaaaaaaaggcccaaaaaatttcctggaattgggggggggcttttggg

SEQ ID NO: 1262 - DNA, 610 bp, Homo sapiens
aatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccagaacattcatcattggggagctccatccagatgacagaccaaagttaaacaagcctccggaaactcttatcactactattgattctagttccagttggtgggccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatc

SEQ ID NO: 1263 - DNA, 470 bp, Homo sapiens
cgacggggctgtgtgcgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagatggtggaccaactgggtgatccctgccatctctgcagtggccgtcgccttgatgtatcgcctatacatggcagaggactgaacacctcctcagaagtcagcgc

SEQ ID NO: 1264 - DNA, 510 bp, Homo sapiens
aaacacagttggccctccatatctgagtttcacagacgaaaaatattcagaagaaaaaaaaatcaatggctgtatttgtactaaacatgcccaggctttttttcttattgttatcccctaaacaatacaacaactatttttatagcatttacattgtattagatgttataactactctaaagaggatttaaagtatatggaatgatgtgcataggttatatgcaaatactatactatttatatcagggacttgagcatccttggattttggtatgtgtgggaggtcctgaaaccaatgtcctgtggatactgaaggataactgtactaatttggagatttctctctactatgatcaagattttcaaacattacattgctgattacattacatcgttacattgtgattctttccaagacttgagataaagtttgggaagaagttaccacttgtttcagtttatgaaatagaaaaaaaaaaaaggggtaaagcatgaaataaaaacctaaac

SEQ ID NO: 1265 - DNA, 611 bp, Homo sapiens
acaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagtagactcctccagggctctgtccacttgcaggaaattcagttcatgaagataagaagtttcttgacaaatacatgccccagttcatgaaacatcttcattatagaataattgatgtgagcactgttaaagaactgtgcggacgctggtatccagaagaatatgaatttgcaccaaagaaggctgcttctcatagggcacttgatgacattagtgaaagcatcaaagagcttcagttttaccgaaataacttcttcaagaaaaaaatagatgaaaagaagaggaaaattatagaaaatggggaaaatgagaagaccgtgagttgatgccagttatcatgctgccactacatcgttatctggaggcaacttct

SEQ ID NO: 1266 - DNA, 594 bp, Homo sapiens
ttactgtcatccctcttggttctagaaaaatagtacaaaaatgacaggtcatcctatgagcgtcatgccaatgaaaccccatcttctggagaaacccttgaatcagaattatcttttttcttgatgtcgtcagatgcagccagtttcttaatttttttaaaaactgtatgtttctgtggtatgtatatttgtacacctaactacctggcacttggaaatcacagcactactcagaggcaattgaataaagaaaaatttaattttaaatatcaagtcctgtcaaacatttctcaaacttctgattttatcaaaggtttgccagccaataaagtgcatcccaagtatacaggggagaaagctagactcctacagggtcctagagtttaagtaatttttttgttattaatataggtaataatttttctaatttttattttttggttccaaatgtaaagctccttgtgtttacctctgtttatgtcattcttgacatgtttatctaaataatgtgtgctctgtgacaggtgaaatgtaaatctgggatccatagtcaagatatcataaggacctacttcccagcctacctttcttcct

SEQ ID NO: 1267 - DNA, 597 bp, Homo sapiens
actgcaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggc

SEQ ID NO: 1268 - DNA, 598 bp, Homo sapiens
gcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccgactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacacccta

SEQ ID NO: 1269 - DNA, 616 bp, Homo sapiens
ttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccgggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttct

SEQ ID NO: 1270 - DNA, 507 bp, Homo sapiens
gggggcattcctgaactgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccggcattgaagttgacttactgaagaatggagagggaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaat

SEQ ID NO: 1271 - DNA, 460 bp, Homo sapiens
ttgatggtcgaggccatctcctgggccgcctggcggccatcgtggctaaacaggtactgctgggccggaaggtggtggtcgtacgctgtgaaggcatcaacatttctgggaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggctggctggaagtaccaggcagtgacagccaccctggaggagaagaggaaaga

SEQ ID NO: 1272 - DNA, 583 bp, Homo sapiens
aagcccctaaactcctgatctataaggcgtctagtttagaaagtggggtcccatcaaggttcagcggcagtggatctgggacagaattcactctcaccatcagcaccctgcagcctgatgattttgcaacttattactgccaacagtatgattctgattcggtcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggattacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcacaggggagagtgttagagggagaagtgcccccacctgctcctcagttccagcctgaccccctcccatcctttggcctct

SEQ ID NO: 1273 - DNA, 554 bp, Homo sapiens
taggttgtgtgcttcgtatgagaatctaatgccagatgatctatcattgtctcactttgcccccagataagaccatctagttgcagaaaaataagctcagagcttccactgattctacattatggatatgtgccgccgaagcaagcacaaagccctacttttacacatgcctagtgatgcgtcatggacaaggcttggctctgttgagtccaactaacctacctgagattctgagatttctcttcaatggcttcctgtgagctagagtttgaaaatatcttaaaatcttgagctagagatggaagtagcttggacgattttcattatcatgtaaatcgggtcactcaaggggccaaccacagctgggagccactgctcaggggaaggttcatatgggactttctactgcccaaggttctatacaggatataaaggtgcctcacagtatagatctggtagcaaagaagaagaacaaacactgatctctttctgccacccctctgaccctttggaactcctctgaccctttagaacaagcctacctaatatctgct

SEQ ID NO: 1274 - DNA, 469 bp, Homo sapiens
caaaaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacagatgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcag

SEQ ID NO: 1275 - DNA, 611 bp, Homo sapiens
agtcagagcctcagcccggctgccctggtggaaggtacaggtgtgcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccggagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagca

SEQ ID NO: 1276 - DNA, 506 bp, Homo sapiens
ttctagcatcctcttaacgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactc

SEQ ID NO: 1277 - DNA, 175 bp, Homo sapiens
cagtgataaaaagtatagggtcgtggcgaaaaccaaacttcacatttttatcctagtgactttccattagagcatttatgctactactcagttttaaaatacatatattacaggggggatttttgaaatttatttatttatttttgagaccgagtctcgctctctcgcccagggc

SEQ ID NO: 1278 - DNA, 515 bp, Homo sapiens
atggccgagcagaaccggaaggatgctgaagcctggttcaccagccggactgaagaattgaaccgggaggtcgctggccacacggagcagctccagatgagcaggtccgaggttactgacctgcggcgcacccttcaggggcgtgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggct

SEQ ID NO: 1279 - DNA, 391 bp, Homo sapiens
acatgtgggttggttttttttatttttttctttaaaagcaatttatttctgattacaaaatacaggtgaggagcatgggcgatgcctgtaaccccttggttgtgcatcttcccagtctatttctgcttctagaaataccctgtgtacaacagcaagctcatgctgtccccaagtgcttgcacattctaacagctgcagagtatatgaccaggtggaaagtccaacagatgccccactcacaagatagggccctccaatcagtcttctggctccctttcactcatagtaactggttgctcttcctattggtcatagataaatgacacctgcacaattctccgagtgctttcaagcaacttcgggaggcagtgactaagaccctttccttgct

SEQ ID NO: 1280 - DNA, 477 bp, Homo sapiens
acatgttttttttttttttttttttttttttttcgagcaaaataattttatttcctaacatatggtaacatatacatccaatatgtgctccccttgcacatctattcacaagtgacttccaaatgacaactgctttgatatttaagcatgtgctaaaagttatcttagttgagatatgaaaaatgctttagatggataacattctgagtatattggattagtcacagcagaatttactttagttagatgagttctacaaatttaaagctttgaaaagctactacttttacttctaatacatccagatgaacacgatgtagcaatatcagcttgtattccagagaaatctcattagtttttctggtgatggaaccacttatccacgtctgttggtactgtgcaggcagattcacagggtggtggtaaagcatccacaatggctctggcagcatcaggatcacacttgaaggggctctc

SEQ ID NO: 1281 - DNA, 551 bp, Homo sapiens
ttttttttttttttttttttttttcctggaaatgtattttattttgtaagtgacaatcaaaatatatttgtgctactgattttttcaaatattaaatgggatcttaacaaaatttgtccactttgatgtattcatgtataactttagaatctgcaaagaccctgactaaagaaacagaagtaattgcacaactgagactgaaggtgttacagtgctgcaaatgatgccagatgtcttacatttagccaagtacaccttcagaggtcccttgattttgagcattaggaacaacagaggaatatacactgaaggcatcattaatagcgtttttcgttgctttatttaaatacgacagtatccaacatagctgctaaacactggacaatatttgaggtcataagtacatccacgtgttcctccaaatgacgtttggggtcctgcttgccaacattctttattgccagctgttcaggtgtcatcttatcttcttcttctacagccttattgtaattcttggctaattccaacatctcttttaccactgattcatt

SEQ ID NO: 1282 - DNA, 402 bp, Homo sapiens
ttttttctttttttttttttttttggcgagaattcactgtttatttgtgcaaagaaaaaaagatatgctgctactgcaatttagccactgctctgtttggtggccagcctcttatctctctcttcagcaacagtaagtcgaatgccctttcccctgggcagggaaatccaaggtttattgccattgccaatgacaaaaatgttggaaagcctcgtggcaaagctgttgccattggcatccttcacatgcaccacatcaaaagaaccaggatgtctttccctgttggtgatcacaccaacacgaccgaggttggctccaccaatcaccatacacaaattgcctgtatcaaatttgataaagttgattatcttgccagtccctaaatcaatctgcacagtatcg

SEQ ID NO: 1283 - DNA, 554 bp, Homo sapiens
tttttttttttttttttttttttttggtcaaatgtttatttctatgccatagttgcctcagcacaatctgtaaaagaaaggaatccaaaaaaatgaaatttttttagtcaggatattttctctgcagttataagaaagaaaataaacaccatgataccagaatcaccatttctttcacatcatcactctagtaagttgcatctaaatattttccttggttgccactttttttaggatggagaaatatccacaggaaaaaatgtctgaattcattaaaataaccttgggatagtctttgccagactgtatcgagaacatctttgtttgggtatgctatatcgctaattgccatattcttattatttaatataacaggcatactttattatataaaacaaagtgcactaaagatgaacaatgttacaaacaaactgaaatttggtgtatcttaaatcttcgggtgatgattagatagtagctgaagcgtgggtatacaaatttcttgttaatacaaatgcaactcttttctgtgatgaaaatgcacttagtagcct

SEQ ID NO: 1284 - DNA, 472 bp, Homo sapiens
gccaaccctcccaaaaagttcatagactgccttttcaaggtgtgccctatgaacagatattctgcccagaagcaatattggaaagcaaagcaagccaaacaagggaaccacaccgaggcagccttgctgaataaactacagcacgctgcagaactggaacaaaaacaaaatgaatcggagaataagagactgttgggagaaattgtaaaatacagtaatgttatacaactactgcatataaaaagcaacaaatatcttactgtcaacaagagattacctgctttactggagaagaatgccatgcgtgtgtccttggatgctgcacgaaatgaagggtcttggttttatattcatccgttctggaaactgagaagcgagggtgacaatattgttgtaggagataaagttgttttgatgcctgtgaatgcagggcagccactacatgccagcaacatagagcttcttgataacc

SEQ ID NO: 1285 - DNA, 483 bp, Homo sapiens
tatatctttagtaaggaatagaaaattggctctgtgtgtatacctattgcattgacctgaaagctgctttatccaatcttcagagaggtgacctactgcatacttctaccttcagaggcatgcctccccagccacccactcccactctcagcccttctccgtacttttctctgaaaggaatcttgtcttgttaaaccctaaagagagtgtccttaatagcaatcagcacttgtaagcttatatactggtgcatttggttttctgttgggtgaatgcggtgtgtgggcgtttgtggattctgaaagaaaaagccgtgtgtcgtgtgccatgacatttctattgcacattctttgtactggcttctttaacagcgatgaacgttcttttccctcctgggttgttcatccacgacagtctctccctgtgctccttcatcacctttccctctctctttgatggctacagagtggtagggcctggtgc

SEQ ID NO: 1286 - DNA, 373 bp, Homo sapiens
tttttttttttttttttttttttttgggatgctgctttatttctgtaaggatacactgaaacgttagatgataatagctaatgacagaatgtagaaatgaggcatcagcttctctaaccactcctacaagaatgttagtatgtattgtcattacatgtttacttttgatattggctcattatactatgtcatataataatgtagaatacagtaagtaggtgatcctgcatttcaggtaagcggtaggtggaaatccagatttcctcttgaggaaaagtcctaggaatcacaacagaagggactttgcagtcctcattaacacatggacaaagagcagacaactactatgttacaagggattcaactagtcact

SEQ ID NO: 1287 - DNA, 630 bp, Homo sapiens
ttttttttttttttttttttttggaatcgcaagaattcccaggccctctttttatttacagtgataccaaaccatccacttgcaaattctttggtctcccatcagctggaattaagtaggtactgtgtatctttgagatcatgtatttgtctccactttggtggatacaagaaaggaaggcacgaacagctgaaaaagaagggtatcacaccgctccagctggaatccagcaggaacctctgagcatgccacagctgaacacttaaaagaggaaagaaggacagctgctcttcatttattttgaaagcaaattcatttgaaagtgcataaatggtcatcataagtcaaacgtatcaattagaccttcaacctaggaaacaaaatttttttttctatttaataatacaccacactgaaattatttgccaatgaatcccaaagatttggtacaaatagtacaattcgtatttgctttcctctttcctttcttcagacaaacaccaaataaaatgcaggtgaaagagatgaaccacgactagaggctgacttagaaatttatgctgactcgatctaaaaaaaattatgttggttaatgttaaactatctaaaatagagcattttgggaatgct

SEQ ID NO: 1288 - DNA, 609 bp, Homo sapiens
tttttttttttttttttttttttacttatattaatattttatttccttctctatagagagagcaggtaaaaacatgtttagtgtttcctcgctttccaagttacattttatcttgagcagatttaaaacgagattagctgtaataggactccaggatgtgggcagatgtctacttgtcaaagacaatctctcttgcaatcagctccttcattatttcatttgtaccaccatagattggctgaactctggcatccacataagcttttgcaattgggtactcccacatgtatccccaacctccatggagctgtacacagtcgtaagctacactattttgtaactcagatgcccaatatttcgccatgcaagcagtggcggagtccaaacgtttcgcttcatgcagctggagacagttgtccacaaatgctcgggttacacatatatgtgtttttaattctgctaattgatgttgcactgtctgtaggtgagcaactgttttgccaaaagcttttctttgtttaacatagttcctggtttcttcaaacatgaattcactagccgaaattgccacatcagcaattaacagcctttcctgtggaagctctttca

SEQ ID NO: 1289 - DNA, 487 bp, Homo sapiens
gctaatggctctgccagcccttctccccaccagagagggcagggggattcaggccctctagaggtagcattgtgaccgtgtctgtagtagtcaatccttgtgtgccacagtccctgactttgttgataagagcatcagcctacatccctctggtactcagtgataagcacctaaaatcttcttaaagaaaaaatttaaaaagctctcaaaatatacgacttaacatatgaggctgcataaatatctttttagcagttgtccaactggtgcttccggttctgcctccccagaaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagagcttcactaaatgtggatgaagaattgaatgaatgaatgaatatg

SEQ ID NO: 1290 - DNA, 488 bp, Homo sapiens
ttttttttttttttttttttttttattctttaaattctttatttcatgtctgtttcagcagtattgaaatataggtttctcatacgtgcaattcttttatagattcaaaagtgaggtgttgtgtgaatgttacaaatcataacatgatccaaatttataagaaagtactttaaaaatcagacaaaagacttaagaattactatgttaaatttctaatccaaatgtaaacaagaatacaggatattggcaatgctaatattcaaaatgggtttaccccagttcataattcctctgctcccctcctacctaaaatctaagaaagtattcattataaattggaagtacagaattcttaaaaagccaactggatgctgagttgtatgattttctttacaggtacaatttacttttcagcaacctgtaagccatggaaagagtaactccatatccaacaaaaaaactcaaagctctatttggctggggaaggg

SEQ ID NO: 1291 - DNA, 286 bp, Homo sapiens
ttttttttttttttttttttgcagtataacagctctttatttctgtgagttctactaggaaatcatcaaatctgagggttgtctggaggacttcaatacacctccccccatagtgaatcagcttccagggggtccagcccctctccttacttcatccccatcccatgccaaaggaagaccctccctccttggctcacagccttctctaggcttcccagtgcctccaggacagagtgggttatgttttcagctccatccttgctgcaagtgtctggtgcgttgtgcc

SEQ ID NO: 1292 - DNA, 450 bp, Homo sapiens
aatattactccggaatggctacagcccaaacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgatactactgtgcaattcctggattgactcagtcagcattgacacccttatcttcactttggagtttactaattggaagacacttgcaccagctgttgaaaggatgctctctgctcgtgcctc

SEQ ID NO: 1293 - DNA, 545 bp, Homo sapiens
agaggcctccatccaggcgggcatctacgccactcgctctggtggggccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttgaagatacaatctgggatagtttgggggaacttgtagccagaatgccctgttcatgctgagcaaagt

SEQ ID NO: 1294 - DNA, 597 bp, Homo sapiens
ctggacagtgacaatgatgattctgactgcccatactcagaaaaagttccaagtattaaaattccaatggacatcatggaacagcaacctttcctaagcgacagcaaaccttctgacagagaaagatcaccaacattccttgaacgccacacatcatgctgataaaattcctttccttcagtcactcggtatgccaagtcctcctagaactccagtaaaagttgtgcctcagattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgtccttaaactttcagatgtgtcctttgataaccaaattctgtcactcaagacacagacacccacagaccctgtcctttgcctcta

SEQ ID NO: 1295 - DNA, 291 bp, Homo sapiens
aggaggtctgtgctcctgcagcttccacttgattacctcaggggatggcaaactcactccctcctgagggtttctttttttttttttttttttttaaaaaaaaattttcttttttcccccaaggttgaattgaaggggccccttttaatttaattgaaacctccttttccgggtttaacccttttttcttccttaaccttccaaataagtgggaattaagggccccaattacccccccgggttattttttttttttttaaaaaaaaacgggtttccattgtttaacccaga

SEQ ID NO: 1296 - DNA, 568 bp, Homo sapiens
ctctgaaaagcaccattaagagagtggacttacagagaagcttcctgggcgttaagccaattgcgttgggaaggtgagacaaactgtctagtcctccctggaggcatgacaggaaaaggtgaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaacagcttaagattttaagagaaaatatgaagacttagaagagtagcatgaggaaggaaaagataaaaggtttctaaaacatgacggaggttgagatgaagcttcttcatggagtaaaaaatgtatttaaaagaaaatagagagaaaggactacagagccccgaattaataccaatagaagggcaatgcttttagattaaaatgaaggtgacttgaacagcttaaagtttagtttaaaagttgtaggtgattaaaataatttgaaggcgatcttt

SEQ ID NO: 1297 - DNA, 603 bp, Homo sapiens
actgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgactggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatcccacatttggtgttgcagatgagttgtaaagccaactgaaagagttccttcaagaagttcctctgataggaagctagaagtgtagaatgaag

SEQ ID NO: 1298 - DNA, 577 bp, Homo sapiens
gcggagcgggcgcggggtcgcgggtgcggaaagcgctaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgct

SEQ ID NO: 1299 - DNA, 623 bp, Homo sapiens
agggagagcgctgttccttctggctgggaagtgcgagccggtggggggagagagaggagtagagcattatgtggaggtacttcccggttcccttgcgtctgagggtcttatgccagaggggatagaaagcccaacagaaactcaagatagaagaaggagaatctgcgagtgtctgtctcctgtcaagcttccctaatacagccctggtagaacttcatcaacagtggaaggcatttgcaaagccaccagacattacattccagagccttgagaaaaactgatgaaaaaaaagtcatgaaaaaaagtcattcgcacaagtgacaccatggtgtgaagtcaaggagcacagactctggagtcagagggcttgagtcaacctgagcatcttcagctttgactgtgaagacacagctttgactctctgtgttgcagagatggtagtgcccactccagtgacgcttgtgaggattagttgagataataaatacaaaatgctgagcatcaaacctagagtagagaaaggtctcaagtaagtactcattaccagtatttgttatttaatttcacttttgtctacattcccttgtgtgaaatggtttggataattaattaaggaaaacttt

SEQ ID NO: 1300 - DNA, 609 bp, Homo sapiens
gttgagccgggtagggaaagcagcctaaagcccgggacaggcgcacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagaga

SEQ ID NO: 1301 - DNA, 539 bp, Homo sapiens
agcccaggggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaagataggctcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagtt

SEQ ID NO: 1302 - DNA, 608 bp, Homo sapiens
gggaggggacgctgagggcccatgtgctgaaaatccgaagtgccgcggaaagtggaggtgagggccgcccgccctagaggtgcccgtccgagaggcagagctgacaaggaaggtttcgagcgttttgctggcaaagggatttcttacaatctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatca

SEQ ID NO: 1303 - DNA, 523 bp, Homo sapiens
tacggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctactattacctgggg

SEQ ID NO: 1304 - DNA, 474 bp, Homo sapiens
ggcaaaaaatcaaggtatttggtcccggaacaaagcttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactggcgcagctcacaaacacctctgcatattacatgtacc

SEQ ID NO: 1305 - DNA, 524 bp, Homo sapiens
cctaccatttatttcatgattggtttcagacttgttcctcctggaaacactccctaacaagcacccttgcaggaatgaagacacaccacacacatctaccccattactgcatgtactcaagagtcagcttttatatgatctctcccaagtgctcctataatggggatctttcactcaccctaaagtgaggacaaaatacttgaaagcatgagcccagtgcctgtaggtgtgcaattaacctcagaccaaggaagtgccgaacgcatctggcttttagcaaggcacctgacaaagtccttcaggatgtttttgtgcatgagctagagaaatgtacctggagaacagcttctactgccagatgatcttactcaaaagatgcagattaagcaaaatatcaacccaaaggggtggtccctgatggcccaccagccctgtgcctggctcgtttcctatgtttcctagatttggtttcagacttgctcctcctgcagacactccctaaccagcatccttgcagaaaactg

SEQ ID NO: 1306 - DNA, 646 bp, Homo sapiens
aaaacagtcgaaatcatagtcctttactcctcctgcccttctccttttgcttaaggtgagcttcaccaggaacattttcgccacaccaaaggaaaactagccagaggcaaaccagctctaagttaatatttgccaattaaatggtttaagttttggattcacagaaacactgacagcatcttattagaatatactgtactgcatatagcaggggctcaatgaatatctgttgaattgagattgatactttcattattattgatgggttcattttacctaatgggtcaacgcgttgtatggatggatgccctgaatattctgatgatttgggttcgacttcttttcttttctacctgaggtgggtgagctacaatgactctgaataatagaatcagcattatattatctagttaatataaaatctgaataaaatctaaggaaatcttggaaagcaatattttcataaaccatatcatcagttgccgaactccccacacatacaagtactatggaaaaagtaatgtctactgcccaggagtcatcttatagaaaccacaattctagaagttgctgtacccacctggaaatccatgctgactgttttgtctcgggtgctttttgctttcagtcctgtgaaggggttcac

SEQ ID NO: 1307 - DNA, 539 bp, Homo sapiens
ctgagtgtgaagtcagcagagctgttactgtggcaacctaatattgtgacctccatcttgaagagtctgcacatttaagctggggatagcgtttcttgacttctgtgaggctccggcaggggaagaggaagcattttaatacatatgcctctcttttacaaaaaagaaaaaaaaatcatcgtaggccctaacatgtaccatgttgacaaaaatgccagatcaaatggatttgagaaataagcccaattcaaggctggctcagccctccacggggcctcccagggaaaggaattcctttatgttcttggaagcccttttctagaaaagccattccattcatacctttgtagagcagtgggctgggtgtggaggacagcgcggagggtatctgcaagagcctgtattttccgcctcccttgcccccactccttttatccttttaaaagtcctatcagccctgccttcgtcccttccgccctaagccctaagagtgggggaggtttaatacggccaatggatcttgtataaagtctacgtaa

SEQ ID NO: 1308 - DNA, 651 bp, Homo sapiens
cctgtccagcctggacggcgacctggcgggccgatactacgcgctcaagagcatgacggaggcggagcagcagcagctcatcgacgaccacttcctcttcgacaagcccgtgtcgcctctgctgctggcctcgggcatggcccgcgactggcccgacgcccgcggtatctggcacaatgacaataagaccttcctggtgtgggtcaacgaggaggaccacctgcgggtcatctccatgcagaagaggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccacgctgaccgcctgggcttctcagaggtggagctggtgcagatggtggtggacggagtgaagctgctcatcgagatggagcagcggctggagcagggccaggccatcgacgacctcatgcct

SEQ ID NO: 1309 - DNA, 634 bp, Homo sapiens
cctggaagctgcctgtccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggacggagccgatggtcaagttcccgggagccgtggacggcgcaccctatatcctggtgatggtggatccagatgcccctagcagagcagaacccagacagagattctggagacattggctggtaacagatatcaagggcgccgacctgaaggaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcagcacccagttcatga

SEQ ID NO: 1310 - DNA, 504 bp, Homo sapiens
ttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcagacctcgggagcccccagctgtctttccccagactcactccgaagccagcggcatggtgacccagctctgaccggtggcttctcgctgcgcagcctccagggcccgaggtgat

SEQ ID NO: 1311 - DNA, 327 bp, Homo sapiens
tgtgtacatgcgcctacgttgtgataatcacatcaagtcttacgaaaaggaaaaggccagcctgccaggagtgaataaagctttgggcaaatatggccctgccgatgtggaagacactacaggaagtggagctacagatagcacagatgatgatgacattgacctctttggatctgatgatgaggaggaaagtgaagaagcaaagaggctactggaagaacgtcttgcacaatatgaatcatagaaagccaaaaacctgcacttgttgccaagtcttccatcttactagatgtgaaaccttgggatgatgagacagatatggcgaaa

SEQ ID NO: 1312 - DNA, 580 bp, Homo sapiens
ggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcccggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaacgaggggtgggtcctgggccccaacaactactacagttttgccagccagcagcagaagccggaagaaccaccattccctccacagaactggccaaacaggtcatcgagtatgcccg

SEQ ID NO: 1313 - DNA, 498 bp, Homo sapiens
tccttatttatttaacttcacccgagttcctctgggtttctaagcagttatggtgatgacttagcgtcaagacatttgctgaactcagcacattcgggaccaatatatagtgggtacatcaagttcatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccacagttgtatgtttgctgattatttatgacccgaaaaatatatttcttctccta

SEQ ID NO: 1314 - DNA, 559 bp, Homo sapiens
gggtctgtaaatttcaattctgaaccttaagctggaggttctcggaacttcagtatgtaagtgcttagacaagttactgagttgctcccggatgtgctgtgagagccattgtaagtgtgactttaaaaaaatatgtacatctctcagatctcattagagcctcatagaaatggaacatgtccttgaaaaccatgaattggaaaatgcatacgttttgagcttgtgtttggggactagctctctgggtcccagtggtaaacttagcccattaatggctgatgctttaaagaaatataaaagcccctaggctagtctcttcttccctccccccatctgcatagcaggtaccaatcttcatcaaagcttttgaaccaagtctcagattgcctttgatcagaagcctggtttgtcccccagtgcagaaatgtaggaactgtgtgagagaaagagaaagagggagagaaggagggaagaaagaggagagagagaaaaagaaagggaggaggagcaggagagagaagcctgtctcgcctactatagaattttcttctctcctctc

SEQ ID NO: 1315 - DNA, 478 bp, Homo sapiens
aagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggct

SEQ ID NO: 1316 - DNA, 401 bp, Homo sapiens
ttcaagctgaactatcacaattcttaatcagttacaatttacaaacagataagtttaaaataaacaatttacaaaatttttgaagcataccttgacatcttgttttgcagttaaacttatctgttaacagctgcctgctgttttctgctcccaaatgaaaggaagcaactcttctgataacgaaaagatacctgtctgaggcaaacgaaacattggcacacagcacagcctcctcaatccactggatcccaactcatctctcatttatttcggcttcttttattccaggattaaggtagggaaacattttcatttcttttcgcttttattctgcttttgtaaaagcagtattttgagagggacattgcctcttcattgaatttctcatcaattcattattt

SEQ ID NO: 1317 - DNA, 498 bp, Homo sapiens
gggtggggctgacgtcaggagccaagatggcggcggcggtcgcactctccttgaggcgccggttgccggccacaacccttggcggagcctgcctgcaggccccccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctatcttgcacccgaaggattgacaccaacctcaataaggtctcaaaaatctaccctcttccacacatgtatgtgataaaggatcttgttcccgatttgagcaacttctatgcacagtacaaatccattgagccttatttga

SEQ ID NO: 1318 - DNA, 644 bp, Homo sapiens
tacggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaaagcacctggtactaagggtactgctgctgctgccgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagta

SEQ ID NO: 1319 - DNA, 524 bp, Homo sapiens
ctcagtgttttatatatgtagtatacagttaaaatatacttgttgccggtactggcagctgatattttctctcttttttcatggattaaccttgcttgagggctttaacaattgtattactttttcaaagaactaagctttagcttcattgatttttttctatttaattgggttttgctcttctctttagcattggaaacatagaaatgctttctgatttctttgggtagatttacgtattcagcttcttgagatggaagtttagatcactgatccttcagcttgttttcttttttgtatacatagattttaggacgatatattttcccttgagttctgctttagctgcagctcttatgttttgatatgcctctctttattatccttcagttaaaaatatctttcaattcattgatatataaaaatatgtgcctagtttttaacatctggagattttctagttttgaaaaaaacataagccaggcatggtggctcacacctgtatccccagcactttgggaggc

SEQ ID NO: 1320 - DNA, 476 bp, Homo sapiens
gaggaggtcctgcccgatcctgtgttggagcagctcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgc

SEQ ID NO: 1321 - DNA, 549 bp, Homo sapiens
aatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacccagcgtggccacctcagctctcttctctcctctcctttccattctctctatggggaggggagc

SEQ ID NO: 1322 - DNA, 565 bp, Homo sapiens
ggggcttcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgacacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgct

SEQ ID NO: 1323 - DNA, 565 bp, Homo sapiens
acaaaccctactcaggtttctagcctggcagagctgatcactaaacatatattccaccttcctctctcatagtcctttctcaccttaaataagcttggtaacaaaaaggcgcaattcacatcaaaaaccgagtaaagtaaacatcttctgaagtgagataaaagaagatgcagaaatcaaaattattccccaaaatcatgttttgctgtcttctctctaatatttaagaaaagatccaatgaaaaccaaaattctttattccccacagctttgcagggtaaaaaaaatatttccctaatgaaaactaattcccaataaagacaaaatactgtctcaattgcataggataaacacctattgctacttatgggaacaaagagtgaatctcacagagagaaggattaagaaaaagtttccctggctgggggcttcccaaatagaggaagctccttcacaaatcttcaaaattctaagtatagcactgagcatttttacatagaataggtaagaaaaagcatctcatctgtctctgaactctaaaagcttacctatacctttcataata

SEQ ID NO: 1324 - DNA, 265 bp, Homo sapiens
tacggccgggtgaggtttcccgtgttgagtcaaattaagccgcaggctccactcctggtggtgcttgcctgtaatcacagctactcaggagactgaggcaggagaatcgcttgaaccagggagtcagaggttgcagtgagctgatcgcaccacttcattccagcctggtgacagagcaagaccctggctcattaaaaaaaaaaaaaaaaattaaaataattttgtcaaaattggggggggaaactttttaaattttaggaaaatg

SEQ ID NO: 1325 - DNA, 490 bp, Homo sapiens
cccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgagaatccagaatttttctatttttcatctgtaatgtcaaggagaagagaattgacagaggaagacatttctgatgattaacaagtcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttc

SEQ ID NO: 1326 - DNA, 436 bp, Homo sapiens
tgtacctggaaataacgaaaaatattttatatggtgatttgtcgcattaatgtctatcttatatcaaattgtgattatcataattcgaaaacagccattaaataaatgctgagcatctcagcttatgtattaggatggacgaaagcagtatcacacataatccatattctcaagtagcctctactctagccagcagatgtgtgctcagagtgaaatgattcaagaagagcaattgcatgcagggactgtatggccaaatggctcataaatgacactgataacaagtggctgttttgatctaatatagttctcatcatctccaacttccccccgcccttcatggattcttcttggttttagtagctctgcaagcataaacaacctctgaagtatcttgacaaaacgattatatctgcttcaagttctttattaatct

SEQ ID NO: 1327 - DNA, 603 bp, Homo sapiens
gttgagccgggtagggaaagcagcctaaagcccgggacaggcacacaggcccaggtgtgtaggccacagcagccgcagtcctgaaaggctgcaacacccaaacccccaggagagaccaggcccaggacgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaagggattccaatcttagctttgaagaatttaagaaacttattcgcaataggcaaagtgaagccgcagacagcaatccttcagaattaaaatacttaggcttggatactcattctcaaaaa

SEQ ID NO: 1328 - DNA, 493 bp, Homo sapiens
aatgataaaattgtactacgagatgcactgggactcaacgtgaccttttcaagtgggatggagtcttgccctgtctccaaggctggagcccaatggtgtgatcttggctcactgcaacctccacctcccaggttcaaacgtttctcctgcctcagcctcccaagtaactgggattacagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttattg

SEQ ID NO: 1329 - DNA, 519 bp, Homo sapiens
gggaaggtgaacagtgtggcccgccatgttcttctccgcggcgctccgggcccgggcggctggcctcaccgcccactggggaagacatgtaaggaatttgcataagacagttatgcaaaatggagctggaggagctttatttgtacacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacc

SEQ ID NO: 1330 - DNA, 441 bp, Homo sapiens
ttttttttttttttttttttttttacaagaacctttattggaaaaatgtccaacaagtgatatcactagcagctgaaggggctgccaggtgagagggggagcacctgaggctccatggaagacattggagtagtgcagtgcagcatctgcctctagggtcagacaattccttttatttgctggggtaagaggagtacccacagaaacacccctctctgagggccagaggcaagatgtggggcagctggggatgctcagagtcctgatacaggtgaaatggggcccccatttgggacctaatggagtagggtacaactagtgactctcccctggaccggggaatggaaggagatatcccatctgatatccactccccaggtccaggggcacagactctgaacagacctaccttctggctctgctcacagtggaaagaggatg

SEQ ID NO: 1331 - DNA, 348 bp, Homo sapiens
ttttttttttttttttttttttttcttataagataggcctttcctgatgccaaataagggcaatgatcagcttccccattcctggagccaggacctgccacatcatttgcagtgcaaaatgcaaatgagagccccttgttcaaagagcaagataaaagtgccatcccaggcgctcaaaatacaaaggttcctcctttcttctatggtctgtcaattggttaaggcattttaatttgctacttaatgtcatgcttgctgggcactggaatactcatgcggtgagtgtaggatcccacgggtatctggaggctcgccctgcaatttagcatgtgcaaggagctccccacc

SEQ ID NO: 1332 - DNA, 527 bp, Homo sapiens
ttctttttttttttttttttttttctatagaacattcaactttatttcaaatataccaattctaaaatttatcaatatacccattacgatgctttctgagtgacataccacacaaatgcaatacggattctctaaagaatcctcttaggctacttcactcaaagtctctgcagctgcctgcactgtgaaggctgcaacataaatctgactcttcacttctccccaggccttggaagggtccactttgctttcaatatcaaacagagcatcataaattcctgggaatgactcccctgcatacttgttgtggctgcttggagcatacatgacatgcctataaaaaggcctgtctggtaaccctaatggatcaataaatgctctttccacaaacatgagttgatcattcatcattcttaatactattgggtagcttttgtcaaagtcctggagtctctcactgaacttggaagcaatttctgaaaaattctttactgcagaaaaaagtgaatcaaatgatacactgtacg

SEQ ID NO: 1333 - DNA, 467 bp, Homo sapiens
ccatttccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtatccaaggcctcacagatcctgaatgcctacctggtcagggtgggtgccaacgggacctgcctgtgggatcccaacttccagggcctctgtaacgcacccctgtcggcagccacggagtacaggttcaagtatgtcctggtcaatatgtccacgggcttggtagaggaccagaccctgtggtcggaccccatccgcaccaaccagctcaccccatactcgacgatcggcacgtggccaggccggcggagcggaggcatgatcgtcatcacttccatcctgggctccctgcccttctttctacttgtgggt

SEQ ID NO: 1334 - DNA, 577 bp, Homo sapiens
tttttttttttttttttttttttggactaaaaaattttattgaactggtcaattttctttgccaatattactgtattcttatttctagtaatagaagtgtgaaaaagcatcaaggaaacttaaattgcattctcatactgactgcatacaataattctgaaaacagcggaagttatatatatcccccataagtaaaacatgagtaacacaacaaatgaaaaacgaataggagacaattcaaataatggcgacctgttattctcatctagttaagtactattattttctaacaggaatttgctatttcaaatatattatctgagatgtctatatatttatattttgagatactatacaaatttgagccaatgacatagaattttacaaatcaagaagcttattctggggccatttcttttgacgttttctctaaactactaaagaggcattaatgatacataaattacattatctacatttacagcatttaaaatgtgttcagcatgaaatattagctacaggggaagctaaataaattaaacatggaataaagatttgtccttaaaaataatctaca

SEQ ID NO: 1335 - DNA, 545 bp, Homo sapiens
ttttttttctcttttttttttttttgtgggaaagctgtttactgcgttctcccgctgtgtgtaattgggttcagtgtggctgaaacacagctttgccccaggctttggcacttccagcctcaggagaggcgctgaaccccagcaaaggaatgtgttccctgtgggcagccggtgcccctggtcactgcagttgcccaaggctgatatttccctgggatccagctggagatgttgggctgggaggccctgtggtcactcatactgcaggagagagaagaagggtacaggtgccagcttctccctgcccttaagcgaggtcagctccaccaggctcacgcactccaggacctcagcctgcaggcggcccagcagctcacaggcagcgttcatggttccaccagtggccagcagatcgtccacgacgaccaccctctgtcctggctccagggcgtctttctgaatctccagctcagccttcccgtactccagggaataggaggcccacagagtggggcctggcagcttcccccgctttcggatgagca

SEQ ID NO: 1336 - DNA, 625 bp, Homo sapiens
gccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagagtgtgcctaactggtatagagatctggtacgagtgtgtgaaaacatccccattgtgttgtgtggcaacaaagtggatattaaggacaggaaagtgaaggcgaaacccattgtcttccaccgaaagaagaatcttcagtactacgacatttctgccaaaagtaactacaactttgaaaagcccttcctctggcttgctaggaagctcattggagaccctaacttggaat

SEQ ID NO: 1337 - DNA, 624 bp, Homo sapiens
tttaccctgtataaacatctttctcttcccagtatttctaagcatgtgacaatgaatatgcaaaggaagcgcagcagtccaccaggtgtgggatatgtgtggcacaattcaagacaatgattaaacctccacttgatgttgcaaaagagattttgaaaaatttgctttcaccacaccagcctaaataataaagaaccagccaccaggtttcagtggaaagtattgcctcagggaatgcttaatagttcaactatttgtcagctcaagctctgcaaccagttagagacaagttttcagactgttacatcgttcactatgttgatattttgtgtgctgcagaaacgagagacaaattaattgaccgttacacatttctgcagacagaggttgccaacgcgggactgacaataacatctgataagattcaagcctctactcctttccgttacttgggaatgcaggtagaggaaaggaaaattaaaccacaaaaaaatagaaataagaaaagacacattaaaagcattaaatgagtttcaaaagttgctaggagatactaattggatttggagatattaattggatttggccaactctaggcattcctacttatgccatgtcaaattt

SEQ ID NO: 1338 - DNA, 121 bp, Homo sapiens
gtggctgggggtaaggaccctgacagggcctcaggaggagttccggaaagccaaggccagctccacaggcagcttcacagcacctgatcccggcctgaagcgcaagtcccctaatgacgta

SEQ ID NO: 1339 - DNA, 628 bp, Homo sapiens
aaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccaaaggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatacaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgttt

SEQ ID NO: 1340 - DNA, 608 bp, Homo sapiens
tacggccgggatagagtctggaaaaaataaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaaccttcacttcttcctattgtaatcgtgtgccatggatctgatctgtaccatgaccctacataaggctggatggcaccccaggctgagggccccaatgtatgtgtggctgtgggtgtgggtgggagtgtgtctgctgagtaaggaacacgattttcaagattctaaagctcaattcaagtgacacattaatgataaactcagatctgatca

SEQ ID NO: 1341 - DNA, 638 bp, Homo sapiens
ttgcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggatcaggaaaggtgacatgacacaggcagagcagagtggcacccaccacagaataca

SEQ ID NO: 1342 - DNA, 520 bp, Homo sapiens
aaccgagaggctgagactaacccagaaacatccaattctcaaactgaagctcgcactctcgcctccagcatgaaagtctctgccgcccttctgtgcctgctgctcatagcagccaccttcattccccaagggctcgctcggccagatgcaatcaatgccccagtcacctgctgctataacttcaccaataggaagatctcagtgcagaggcccgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttgttttcccctagctttccccagacaccttgttttattttattataatgaattttgtttgttgatgtgaaacattatgccttaagtaatgttaattcttatttaagttattgatg

SEQ ID NO: 1343 - DNA, 399 bp, Homo sapiens
tatcgtcagacatgagaataataaaaacggagtcgatcaggaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgataa

SEQ ID NO: 1344 - DNA, 520 bp, Homo sapiens
ccggggagtttaaaagagtttgtatatatttaaatgaataactttttatactctttgttacatgtttgtatcagtatttagtggaaaaccatttgagttgtcttgggttagaatttttctttttgtactgtttccttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttaacacttcctcgatgtgcctgccctgagggagtgagttcacatttgagacagctgcactccactgtggacgtgcctttgtcttcaggccatgccgaagggtgtttaaagcagtcttgcaggtcgctcctttcccagccgtggataaaaactgaagctaggaatctaataaggaatgctgatttcctcagttc

SEQ ID NO: 1345 - DNA, 549 bp, Homo sapiens
  misc_feature 344: n = A,T,C or G
tacggccgggcctcatgggcagtggcaaagaagatacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacantgggagtttctcagactgattcttgacctctcaatgaaagtgttgaagcaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattatcttcaatttggatat

SEQ ID NO: 1346 - DNA, 466 bp, Homo sapiens
attatgtgattaatgatttgacagccgttccaatctccacgtctccagaagagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagg

SEQ ID NO: 1347 - DNA, 588 bp, Homo sapiens
ggcaaaaaatcaaggtatttggtcccggaacaaagcttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggag

SEQ ID NO: 1348 - DNA, 665 bp, Homo sapiens
ggcaaaaaaatcaaggtatttggtcccggaacaaagcttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactgtacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcatctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgg

SEQ ID NO: 1349 - DNA, 555 bp, Homo sapiens
acaaaatataaataatagtgtatgcaagttaatgtacattatacatgcgtgtaagggacataaatggaggggtgtgaactttggttaggcaaagtttactggaggaggggtttttgagtcaaatttggaaggatgaacttgttagatagtcagagttggaaacaaaacactccaagaatagggatataagcattgctagtctggaatagtctattccttgtgaaaatataaatttaattttcaggaatccagtatattccaaacatcacatatttagcatgagaaaaattgatttgtgattgtgtatatgagtcattgttaatgggagacaagctgaactgccacatgccaccaaatgaacctttacttcaatcaaaaaggagggtatgattggttcaattatattaacagaacatcatgggcatttctctatgatggtcattcaaggtagtaggtctctttcaactgagtgcaacattgagagtaatgatttggttcagggcaactacaaataatcacttactaagccttatataaagccattatttttatatc

SEQ ID NO: 1350 - DNA, 612 bp, Homo sapiens
aggcggaggcggataagaaggccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgct

SEQ ID NO: 1351 - DNA, 606 bp, Homo sapiens
gttggggcagggcaagtgtgtcctctctgtgttaggtgattagggaagagtttggagagagtgccatttgggctgagatttgatcatgaagagccagttgtgtgaatatcattgatgagcatgagggccaaggaagcaccgggaagtcccaaggcagggaccggcttggaaaggaacaccaagaaggccagtaaaagaaagaaagccaagaaggccagtaaaagaagagccccaagaaggggctcgctagtgtccagtcttgtaaagtttcattctgagtgaattagaaagccactggagggtttatgcaggaaaaggaggtgggtagctggggttctgtaagttaacacataaaataatttattttgactcatctgcaagtgtgtgttctaggtaatttcgctttaaaatggtactgtgattcctctgaagtcatttattatgcaaattaaggacagcttgtcagaacctctgggtttcttgtgtcttgcattactagctgcaattcgtatttttcccatatttaaacattttctttttagttatgttctgtgatatatggaagggaaatgttcatgtagttcagtctatgtctttccctttctg

SEQ ID NO: 1352 - DNA, 583 bp, Homo sapiens
gcaatataatgtgataagttctttaaaagagtaagagcaacgtgctttgggagcagagaagagggagaaagcagcatcttgcctggatgagctaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgac

SEQ ID NO: 1353 - DNA, 601 bp, Homo sapiens
ttttctagccatcattccttccctagggacatcttcatcaggagcagggatgggggtattttttctgtcccacgaaggggaggggagagcagaggtggttggattctggtgaaaccccatacaagttccccgcagcccttcccgtctgtgcctttccccgttggcgggcgtttcatggagtgggaaggggcagagccatgagagtgagctttctggctcactgaggagggtactgttggccccatagagagaagatgggatttcccagatgctctggaaaacctgtcacctttaaaatctcaggattaatcctagtttctggtctccgctccttgtacatcatctcattttgattcagggcagtttaatgggtggtatcgtgtctattctataggtgcgcagactgaggcttagagaaaggtttagagcttcggttctagagtcagatgggacttaagtcccagctctacctcttaattgctgtgaccttgagcaagtggtttagcctccgtgtgcctcagtgtctggtacacagtgggcactcaggaagtgtgggccctttaggtcaaaggagcctgagtacaaagttccccgtgagcct

SEQ ID NO: 1354 - DNA, 620 bp, Homo sapiens
ctgaccgagtgagcctgcggaacctgcgcggctactacaaccagagcgaggccaggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcgcccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggggatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccag

SEQ ID NO: 1355 - DNA, 590 bp, Homo sapiens
acatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtccttcaagacccagcttggatgtcacctgggtgatgccgtccctgactcccactgagcgacccatttaggcctcattcctgcatcagtctttatgtacttcagttacaaaatcatcacatcttagtgtgattgtttcccactccctgactaaattgtgaggcctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttg

SEQ ID NO: 1356 - DNA, 590 bp, Homo sapiens
cgacacccagcctgcggggtcgtctggcgcggtttgggaacccgcggagcctgtgctgaagcccaataaacctctcattctagctaaccgcgtcggggagcggcgccgggagaagggcggtgagcagtcggagtcaggacggccccggagcgaaagccggagcatgagcaggggcgggtgggtaggagggcaggaaggtgggtcttcttgtgactgaaggtcccccggatctgcccctccagaggcgacttgcatcacggagatgtcggtgatgatggcttgctggaagcagaatgaattccgcgacgatgcgtgcagaaaagagatccagggcttcctcgattgtgccgcgagggctcaggtgaccgatggctcctggggtgctttctcaggaaaagaatgggggagatagaagtaatgattctccctgccttttgctaggaaaggccctttcattcatttgggaggtatattattcacgccaaagtgggaaaggttacagttttgaaggctgtgagatcttgacggatttattcattgctctgaactttcgagttactgtacgtaaaatgaggctaaccgataccacc

SEQ ID NO: 1357 - DNA, 587 bp, Homo sapiens
atggcattcagcatagtgtagcgccacctaacggctgtgggtggagagttcccggctgagacaagacctgccggtgctttgaagtgaatggttccttgagccacagatattcaaggtaggcaaatagagagtgtttttctttatatgtgtctcccagctaataaagctagattaaatggatagaattaagatttcaccactttgcaactcttgatgaaaataatagattagacagtggtcttcaacagctgccgaaagtattaggtgcaaagctgataggaaaagcggtgtaatggtagggcaaggatagaaaacagctaatcttctaattagcagaagagacagtccagggacagatccgtacctcagcgtcatctgacttacaacaaagatgccattgcaacgcagcactgcagtgggtggggaagactgcctggacacgttggtctccctcactccatgtacagaatcccttctagatagatggtagaccaaaaggggaaagtaaaataacaaagcttctagaagaaacataggagaatatcttcacgaccgcgggtagatttgttaaacaggacacagaacaa

SEQ ID NO: 1358 - DNA, 499 bp, Homo sapiens
cttcagcgcctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccc

SEQ ID NO: 1359 - DNA, 606 bp, Homo sapiens
tgcctccgtttccctggccgctcacgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccga

SEQ ID NO: 1360 - DNA, 431 bp, Homo sapiens
tgtccagggcacaggacagggaagggcgagcctcaaggaatgaatctgcaagagggtgggagcaggtgggaggtcctcctgggggctcctgtcatactcctggggcggccaccactgtgtcacagttccctctcagactgtaaggtgggatgtctcccctcagcatggctgccacttctggaactgtacgaactcctgtgtcagctgaggacacggggcctgagtgctgttgctactgcattgatgtgttcctcgaatcaaacctagagaaatgagctgggtatggaagcacatggcatttaccttctctttcccccacttttccccagaaactccatgttgccaatgtgctggaagatgaccccggctacctacctcacgtctacagcgaggaaggggagtgtggaggggccccatccctcagctctctg

SEQ ID NO: 1361 - DNA, 493 bp, Homo sapiens
aaatcgactgcaatttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtaagggagagagcccggcgatagggcggcgatttgtatggtttcggcctcaggaaccactgaaatacttccctagcccagtcagttaggctaagacacgcactggcccggagagaatcacagttgtcacttacaaactagacatcttgtgggttctgtagctaggttcttcctctggaaggtttgtgccagagatctgtggatcttcatgctattacctcggaaagacaagagatacttattaaccttggacactgatagaaagtataaatttaagc

SEQ ID NO: 1362 - DNA, 95 bp, Homo sapiens
aactcctcgtgacaggcctttctggggtctgatcgccctttgtttccttacacttgggcctgttatcagaagaactctgaatccggaaatacctt

SEQ ID NO: 1363 - DNA, 639 bp, Homo sapiens
ttgatgttaatctgtgtttcctagtcttgagaaatggattttaggctgggttctagagagctggggtgatagtgggctgtgctggtggaggtgaagatgtagagtgttctagaggtgactaacattttaagctaaagattgttggcaaatagaagatgaaagaataggaaataattccaagatcttcaactcttctgcattacaatatgtaaccaaatgatcttaattgtctagtcaaccaaagtttacaaaaaataaattctgccataactgtgactcaaatatatgcgaatgcataaaatatgggtaagaaagtgaatttgaggcttgaacacaggtaattaagaggatcttataagaattgccaagacttgatggctaaggactcaggtttagaatataataaggaaaggtcttctgcttctggctatgacagagttgctagaatcagatgaattcatccactgagaataactataaaacttgagaacaactataaaacttggacaaaatacaaagcaaaacaaaacaaaatctgaaagctctgtagaacaaccagggcagccaggacctcagggaccaagatcctggagagaaggaaaacatattgaagtgagtactgctctgagtacagctatt

SEQ ID NO: 1364 - DNA, 632 bp, Homo sapiens
aatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattggaagataaaaacatacttttagaagaaaaaagataaatttaaacctgaaaagt

SEQ ID NO: 1365 - DNA, 427 bp, Homo sapiens
tacggccgggtgtggtagctcatgcctgtaatcctggcactttgggaagccaagatgggtggatcacctgaggtcaggggtttgaaagcagcctggacaatatggtgaaaccaccgtctcttctaaaagtacaaaatgagcaaggtgtggtggtgcatgcctgtaatcccagctacttgggagactgacgcaggggaatcatttgaacctgggaggcgaaggttccagcaagccgagatcacaccactgcactcctgcctgggatacaagagtgaaactgtctcaaaaaaaaaaaaaaggggacccaaatttttggaaggcccaaaaatttttcccccggttttagggaaaaattgacccccccggtttaatttttttccgaaaaaaaattttcttaaccccggggggggggccctttaaaaaaaaa

SEQ ID NO: 1366 - DNA, 633 bp, Homo sapiens
tgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgatctgtgtttcctccccagtcatctttcttgttccaaagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgaaagagcaaataaagac

SEQ ID NO: 1367 - DNA, 643 bp, Homo sapiens
catggggtaataatggactgacaacttgaatacttcacctcttagactctaagtttttggttctcttggactttgtgctgcattagatactaatttgatttaaaaaaataaaactttcttaaaagatgacagtcctgttcgtcttgatgccttactaaatgctgtccccaattttttccaaggatgatctggatgattatcttcatggcatatgtagatgcctgtatagttattcatagatagttgtaccatatgataggaaggtcataggaagacctttcactggagtaaaatggtcaaaataagagatgaacaagataatgggagaagtgaagataggtaagtataaggttgaataggcaaatgttaaccagaattaaagaaaataataaaaagtgtgagctttacaggtgatgagaagaaacaatttagcaataaaggagcaaaaggaagagaaagaaccaaactaactctaaactgtcatatgtatccagggtggtaaattccaaaacatttgcaaaattggatgaaaaagagattaatagtgtgtgtgtttataaaaaaatatagacaagaatggtcttcccatgttaaatttcaaagatgcaaatatttgacaaaacattagaataataaaacactg

SEQ ID NO: 1368 - DNA, 476 bp, Homo sapiens
gactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccggcagtcctgaccacatgctcgccatggtggaggaagcccgtcgcctccagggatctggccctgaacccctctgtgtccactgcaggttttggaaatgggcttcaggagggtctggtgaggcagaggggacagagcatggaggggagtacagggcatggggctagtcttgtagtctgagtgcctattttgagaacccttgctcaccctccatggactgtaattgtgagcacttgttcagcacagactcagctggggaataagcacacagctcttgctcaacaaaatgtaagtgattaaaaaggttttccttgtcccaaaaaaaaaaaaaaa

SEQ ID NO: 1369 - DNA, 103 bp, Homo sapiens
taggatataccagggtgtgatccaagctatccagaaatcagatgaaggccacccattcagggcatatctggaatctgaagttgctatatctgaggagttggtt

SEQ ID NO: 1370 - DNA, 204 bp, Homo sapiens
atgatttatctaacttggggaacaaaaataaaccagattaaccacaaccatgccttactttatcaaatgtataaggagtaaatatgaatcttatatgacaaaatgtttcattcattataacaaatttccaataatcctgtcaattatatttctaaattttcccccaaattccaagcagagtatgtaaattggaagttaacttat

SEQ ID NO: 1371 - DNA, 358 bp, Homo sapiens
tttttttttttttttttttttttttgcgcggcaggatgctggtttatttactgtaggatctccagggccatcaaagccccctcgtgggatagggagactatttacacagccagggaggagggcagccaggaggcagagaccgggtcccgtatttccctctgcccgaatgaggaggggaggggtgtcctgggtcctgcagctgtagtcttggggttcagatggaaacttcatactcccgcgtatccccagcttcatacagcgggttgctgaagtccgactccacggtgatggggctgtaggagtgggagcccgagaagccgaaaagggactttccctgaagcctgggaagggagaggac

SEQ ID NO: 1372 - DNA, 449 bp, Homo sapiens
tttttttttttttttttttttttttggactcataaagtgctctttattggcatctgaaaaagaagtgcctcagccttcaaggctgggacagaagttggggaggagctgctctgccccaggctcaataccaatagaccttcttgtatttccgggtctccttgatccccatggcctccttcacctcctcctgcagtgtctttagacagggcacatgggttctttctaaagcatcttccactgatgtgtctttggggccgtcaatccacgtttcagggacgatgccatcagctctgggaaattcgggtttagggataattctccctgatcgtgtggagactcgtacccgctctcctgcttcagtaaatctccactcgatctcagtgggtttcctgtccataggatccacaagtttgacctggcggtggagcaagggggcttcactagggatc

SEQ ID NO: 1373 - DNA, 529 bp, Homo sapiens
tttttttttttttttttttttttttttcgggggtttagagaaatagtccttttaatatgacttagaaactgcttttctctggctttgtttcactcttcttcctcttccccttccccttcaccttcctccatcgtttccacaatgagctctgctgtgcaggtggcttctccaagactgttgacagccttgcaggtgtacttggcatcgtcatccccgcaaacatcactaataattaaagagcagttcccgtcctcatcgtagtctatctggaagtggcgggactccctgattgactggtcatctttgaaccagacaacctcggggtctgggtatccttcaatcttgcagtcaaatctagcagcacttccctccacaacttctaaatcgcgaatggtcttagagaaatagggttttacatgaggcttttcctcagcaacagcctcaaggaaagcttgggacacatcttcttcagattctagtttttctgcattgagcgggctggttggtgaccctgttgaggatttcctgc

SEQ ID NO: 1374 - DNA, 257 bp, Homo sapiens
gagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcaaacagggtgtgctgggcatcaaggtgaagatcatgctgctctgggacccaactggt

SEQ ID NO: 1375 - DNA, 581 bp, Homo sapiens
ataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctataccctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagt

SEQ ID NO: 1376 - DNA, 581 bp, Homo sapiens
gtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgc

SEQ ID NO: 1377 - DNA, 600 bp, Homo sapiens
agggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgtgcggcatccctccggccccaggggcgtgccccagatcgaggtgaccttcgacatcgatgccaacggcatcctgaacgtcac

SEQ ID NO: 1378 - DNA, 557 bp, Homo sapiens
cggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaaggggacccccgccccctgccctcccctctctgca

SEQ ID NO: 1379 - DNA, 481 bp, Homo sapiens
atatggatcgatatggtggccgggatcgctatgatgaccgaggcagcagagactatgatagaggctatgattcccggataggcagtggcagaagagcatttggcagtgggtatcgcagggatgatgactacagatgatgcggggaccgctatgaagaccgatatgacagacgggatgatcggtcgtggagctccagggatgattactctcgggatgattataggcgtgatggtagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagaaaagttgcagcgtcagctggatgaggcaaaactagaacgacggcctcgggagagacacccaagctggcg

SEQ ID NO: 1380 - DNA, 585 bp, Homo sapiens
tattattttgagggaaaagaaaatttcaagcttttcaccattattctttttaaactatcagaaatatttatcacacatactatctattttcttgggctcttgttacaatgtagtttacctttacttttcaaatggtccttagatcaaattatttgattttgtactccacaaagacacatattattccttgcttttatagaattttgagactttggcccacacaaatttcttagaagacaataaaccaggtaaaaacactaacttgcaattttaggtgtcttttttatttctcttacatttgcatccgtagcaaccatttaaccttgtagaccttatgaggccctcaataatactgtatttctaaaattagacaacataccccccaaactcatgtttctgtttccctactttctctcttactttaaaattgtagtattcccaagagttcagtggtggcaaatgttaataaaataagttagtacattttggaggttcttatatcctttgtagggtaagctgatagtgtttagatttctgttcccattattccagtagtgtattaaattatttaagataaataattac

SEQ ID NO: 1381 - DNA, 596 bp, Homo sapiens
atgtgaaaatgaaatcattttaagacagtggaatttttggtggtttttctctccaaaattttctttaatactattgcttactcatcttttcagaaatgattttaaatatgtataaactttccatgcccttccctgcactatgtacagaaatagaatctttaatgtggatcacaaataacacaataatcagaaattagagatggtgttgaatctcagcattggtaatgagaataggctttatggatagatattccactttatcctgagatacacagctacagtatactttctgggaggagtatgcctataagcatccttggctggaacctgaattgggtttacaagcttacatttagataaaagcctttttatttgagatgaaacccatacaggcagggtagaaaggagtggcctgggtgagaatgtctaatgtttgggttttctcaaagcgtcattcctcctttcctcttattctggctagcttttccacagtgtcatgtaaagaggcagcattttctagaagatgcaagtcatttgaagtagtcatttggttttctcctcatttcactttcagcctgcctttaaaaatgtagctg

SEQ ID NO: 1382 - DNA, 592 bp, Homo sapiens
tacggccgggatcttcggcaagaactcacgtctccaacaaccaagctccccaacaatggactcttgtggctgacttcactcaccatgctcacactgcctccttgtcagcagtagctgtaaatagtcgttttgtggtcactgggagcgaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttc

SEQ ID NO: 1383 - DNA, 568 bp, Homo sapiens
cattcgggccgagatgtctcgctccgtggccttgctgtgctcgcgctactctttctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgctaacatggacatgatcttctttataattctactttgagtgctgtctccatgtttgatgtatctgag

SEQ ID NO: 1384 - DNA, 638 bp, Homo sapiens
gtgacaggcctcgccggaggagctgggccctgaatcaccctgctccccggccggctgtcggcgctgggggagggggtcccgggggtcgactcaccgatctgcccgatgaactcgatcttgatgccctggtgctccagccgcttgttggggttcttgagggcaaggctcaccttcccggagaccgtctccccgtcgtagaagaagaaatatttctccttcttcccgtcctccgtcttgtgctcggcccgcttcctactctctgcatcgttcagaaagatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgctggatcttatactcgaatgggttgacacagtgtgggaactggatttcacagagactgagcctttggatcccagcatcgaagcagagatcatagagactggattggctgcatttacaaaactctatgaaagccttttaccctttgctactggagaacatggatctatggagag

SEQ ID NO: 1385 - DNA, 474 bp, Homo sapiens
cgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgagggg

SEQ ID NO: 1386 - DNA, 383 bp, Homo sapiens
atgggtacagttaggaaagtttttttcttacaccgtgactgagggaaacattgcttgtctttgagaaattgactgacatacctggaagagaacaccattttatctcaggttagtgaaggatcagtgcaggtccctgactcttattttcccagaggccatggagctgagattgagactagccttgtggtttcacactaaagagtttccttgtgatgggcaacatgcatgacctaatgtcttgcaaaatccaatagaagtattacagcttccttctctggctcaagggctgagttaagtgaaaggaaaaacagcacaatggtgaccactgataaaggctttattaggtatatctgaggaagtgggtcacatgaaatgtaaaaagg

SEQ ID NO: 1387 - DNA, 433 bp, Homo sapiens
gatataaatgggttaatggtctatttttcagtttttaccacaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccctccccaaaatttatatgatgaagcccttattaatgtgatggtatctggagatggggctcctcccaccatcccatcctggaacatataagccagaaagaaagtagtctccccaaacagaccatgctgacaccttgagtttgaac

SEQ ID NO: 1388 - DNA, 527 bp, Homo sapiens
gggaggtgacagtgtggcccgccatgttcttctccgcggcgctccgggcccgggcggctggcctcaccgcccactggggaagacatgtaaggaatttgcataagacagttatgcaaaatggagctggaggagctttatttgtgcacagagatactcctgagaataaccctgatactccatttgatttcacaccagaaaactataagaggatagaggcaattgtaaaaaactatccaggaggccataaagcagcagctgttcttccagtcctggatttagcccaaaggcagaaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaact

SEQ ID NO: 1389 - DNA, 451 bp, Homo sapiens
gaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacgaatactaccagcggtatatggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatc

SEQ ID NO: 1390 - DNA, 537 bp, Homo sapiens
aaaaggatataaaatttgaaaagagaaacctaattggctatttaatccaaaacaactttttttttccttcaatggaatcaggaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctaaaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattct

SEQ ID NO: 1391 - DNA, 528 bp, Homo sapiens
aatcagaatgaatatggtgactgggacgcctgtacattgctttgacttaaaaattgaagtccattattctgaccgaaagttaatctgatgattaattggttaaacatactatcgttgctaattagcataattattatttacaataaagtgagctaaatagctacaactaaaatatatttaaattactgtgatattgtgatgctaaagatgtgttgaaattaatatcttgaatttctcaaccctgcctaaatgcctctgagagtaattagtataattaaaagtcactagagaaagtgaatgactctaataacaggataacaaattcttttcaagtcagatggtttccagttctttgctttcaacaaaattaatggtggcccatgaattgtcagctgatgaaggaacactatttggtttttggcatgcaactcggaaagaaaccaaacgattgattgacatgcttacaacaaaactactagcattctcacctatttatgtaaaaccatttctcagcacttgtatctgtga

SEQ ID NO: 1392 - DNA, 151 bp, Homo sapiens
caggttttatgggttcttcgaacctttagggagaaggacccattggggcctttttattataagggaaaaaaaggaagtttattttatcagggggactaaggccccccggttgggggcccctggcccaaaattaaaaataaatttggagggt

SEQ ID NO: 1393 - DNA, 658 bp, Homo sapiens
cgccccatgtgtatgttgctatatatccatacactcctcggaaagaggatgaactagagctgagaaaagggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggagcgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgact

SEQ ID NO: 1394 - DNA, 561 bp, Homo sapiens
ctgaggcaggaaactcacttgaacccgggaggtggaggttgcagtgagcccagaatgtgtcattgcattccagcctgggtaaccaagcgcgactctgtctcaaaaaaagaaaaaaaagcaatatactgtgtaatcgttgacagcataattcactattatgtagatcggagagcagaggattctgaatgcatgaacatatcattaacatttcaatacattactcataattactgatgaactaaagagaaaccaagaaattatggtgatagttatatcgacctggagaaatgtagacacaaaagaaccgtaagatgagaaatgtgttaacacagtctataagggcatgcaagaataaaaataggggagaaaacaggagagtttttcaagagctttctggtcatgtaagtcaacttgtatcggttaatttttaaaaggtttatttacatgcaataaactgcacatacttcaattgtacattttggtaattcttggcatttgtagctctataaaaccagcaacatattaaaatagcaaacatatccattacctttaccaccaaag

SEQ ID NO: 1395 - DNA, 561 bp, Homo sapiens
gtcaggatggtgtcacatttttatggaaatggagatatttgtgatataactgacaaaccaagacaggtgactgtaaaactaaagtgcaaagaatcagattcacctcatgctgttactgtatatatgctagagcctcgctcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcactatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaag

SEQ ID NO: 1396 - DNA, 556 bp, Homo sapiens
attagcagctacttaaattggtatcagcagaaaccaggaaagcccctaaactcctgatctatgctgcatctagtttgcaaagtggggccccatcaaggttcagtggcagtggatctgggacagatttcactctcaccatcagtggtctgcaacctgaagattttgcaacttacttctgtcaacagagtcacacttccatgtgcagttttggccaggggaccaagctggagatgaagcgaactgtggctgcaccatctgtcttcatcttcccgccatctgatgagcagttgaaatctggaactgcctctgttgtgtgcctgctgaataacttctatcccagagaggccagagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtg

SEQ ID NO: 1397 - DNA, 530 bp, Homo sapiens
tgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctgacattttggtatctttcatctgaccatccatatccaatgttctcatttaaacattacccagcatcattgtttataatcagaaactctggtccttctgtctgg

SEQ ID NO: 1398 - DNA, 541 bp, Homo sapiens
acccctaccaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtgggatacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattca

SEQ ID NO: 1399 - DNA, 637 bp, Homo sapiens
gggtgggcctatatagatgttgaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacactt

SEQ ID NO: 1400 - DNA, 367 bp, Homo sapiens
taccaaattgttggcaaacttgatgtaaccttatatggtggttttagtcccttcttatggttggcagaagggcactgaactgttgggtgaaggttagttagcaagtaagattataaggaagacacaaaagacagtggcaaagagggttgattaaatctataagtttttatgtgaggactttgtaagtcagcataaaaatgaaaagttgtttctcagttgtttttgcttttaactttgcccccagcgtttaaagggagtgatctgctttacaggatactatgcaatgcttgttttccaactatgttgaataaatattaatatttatcagcaaatactcctttccaacttccttttttttttttttttt

SEQ ID NO: 1401 - DNA, 605 bp, Homo sapiens
tttttttttttttttttttttttttgcaggtgatctaaaaatactgtttatttacagtacatccctcttaggggcaagtctctgactggttctggacctgccacagttcacttggccatgtcgatcaggctctgcagtgaggtgggcacccacgtcttctcgccctggacaaagaccactccccggtcgatgtagatcacaatgcggccaaaggtgtagagctgcttcccttcgtgtcgcttcccaatgacgggcatgaagacaatgttgtgctcctcagccttggtctcaatgaggtccttaaagttcatgggcacagagctagcggccacgccaatgcccctctgagccatgttctcagcctcccgcctctcctgcatggcctcgtactggaagtccttcctccgctccgtgtgggtgagataggcaatgttctcccgtgctcctggctgcatgtaggcaccaacgttggaggacaccgcccggttcatgatatcaagtgcctcattaaatttgtccttgacagatggatgtgccagcacttggtctgagaacatcgacttccaacccaggtaccacttggtgatctcctcataatttgggct

SEQ ID NO: 1402 - DNA, 593 bp, Homo sapiens
ttttttttttttttttttttttggggatagaaataaaaccactttactgtttagaataaaggacacactataaaaagtgaacattatgcaacattacaagacaatatacattcacggaatataaaattcataaataacatggaggaaaactgtaaacagtgctacgaaatttagcaacaaatacattccttctagacagggttcgagatctcttgttggtttctctccatcacttctgggtttcaggacagcagactggctaaagggaaaggcggatgctgggagaatctaagaagcctctacccccaaagcaaaaactattctccaagttctccccttcctctcgcctccaaagagccaatttggaagttgttgtcacatccacctcccctactttccattttgttttgcttttgccatcagatttttataatgtttgtctctcataaaaatactctagtgacatgttaaccttaggtagccagaagccaaacacttgggtgccatcttggggtagtccagattgtcaattgtcacatgcaagacagaggtctggggcatggaagggtagtgtctcctgggggccacagttt

SEQ ID NO: 1403 - DNA, 458 bp, Homo sapiens
tgcggccgccatgttttttttttttttttttgcgaattcactgtttatttgtgcaaagaaaaaaagatatgctgctactgcaatttagccactgctctgtttggtggccagcctcttatctctctcttcagcaacagtaagtcgaatgccctttcccctgggcagggaaatccaaggtttattgccattgccaatgacaaaaatgttggaaagcctcgtggcaaagctgttgccattggcatccttcacatgcaccacatcaaaagaaccaggatgtctttccctgttggtgatcacaccaacacgaccgaggttggctccaccaatcaccatacacaaattgcctgtatcaaatttgataaagttgattatcttgccagtccctaaatcaatctgcacagtatcgttcaccttgatgacaggatctgggtagcggatggttcgagcatcatgagtca

SEQ ID NO: 1404 - DNA, 514 bp, Homo sapiens
aactctcaaataccccattgagcacggcatcatcaccaactgggatgacatggagaagatctggcaccactccttctacaatgagctgcgtgtagcacctggagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcgcggactacctcatgaagatcctcacagagagaggctattcctttgtgaccacagctgagagagaaattgtgcgagacatcaaggagaagctgtgctatgtggccctggattttgagaatgagatggccacagcagcttcctcttcccccctg

SEQ ID NO: 1405 - DNA, 594 bp, Homo sapiens
tttttttttttttttttttttttacccttgtgtgtgtttattgattctttttaagattgaaacagactattacaacaatatttgagatttcacagagaactgcgtgcttttgttattaaaagacttttgttgaaaaatttgacctttacctcttatgaacgaaagaaatatagaggtttcaagcatctttgccagcacagagtcattcacaacaaccttctagatgcttattttccaccttttcctacagaaggtaatattcagttaccagaaggccatctccaccactgaatgattcaaagcttcagagctcaaaagtgatcagaactcacaaattagcataattagtccaaagcttgatttaaatgtttgaagaacagcaaacatcaaataatataataccaaatagaatattatagtctctatgaggtaataactcatcagctacaaccacctaaaactgaaattttctgtacttagtttctattagtacaacaccttcattcttaatgcttcttagggcatcacaggttttagaaattaatgtatttttagcattccacagtaatgatcactttcaaaaactgcaatata

SEQ ID NO: 1406 - DNA, 479 bp, Homo sapiens
atttaatttgtaaacattgtgcaaattttaatagcttaaattatatatacggcgctgaaaaaaatttgcatgatcaattgatgaggctggtgtgataggatccttgtgtttgactgctttttcttgctgaggatgtagacttgagaatggcctggaatctctaagaagtaagagtttattgaaaaagtaaaacagtaaaataaaagtggaagcaatctcagagactagtgtaaaaaaatgtgtgtttgtgtataaatttaaaaaataaaagaaaaactttaaaaagagacaactgcaagagcagttacctttaatgatacaaaacaaatttcttacaggtgttaatttatcagcttattaggcaattactgaaacagataattacagtttaagcttaagagatatagttacacaggcaggtcttggttcaagtgcctgtctcattaccctttataagacaatattgctccttgaacctc

SEQ ID NO: 1407 - DNA, 169 bp, Homo sapiens
ttatactatattggttaatgacaaaaaaaagtttgtacatgttcagcaaaggcgcaaccatccatttttttccccaaatatttttgacccacagggggctgaatcacagatgcaaagcctatggacatggagggccaactggaaaagcataagcaggggatacttttta

SEQ ID NO: 1408 - DNA, 514 bp, Homo sapiens
ttttttttttttttttttttttttttacgagcaagtatggtttattacggacaaatggtagaaaaatgttactaatatccatagataagttccttaagtcatgtagagagactgttattaaaagtttgctgcatttttctattgaatcaagaactagctaccagttacagtgccttctaaacacacagttagctttgctttatcaataaccaaataataaactaggtcccaatggttttgtccacatctagattgttcaggtgatcaggaactcttttatttgtgtgctttagcttttagtccttggttatatctccaaatacgaaaaagctgagaggctcctgctgcccccacaaagaaattaacagcaaacagactccaattttttggaataattacaagtgagtatcttgaccaaataaaccctgtagccatcaaaacagcagattgagctgtgctaagtttttctgcaggtctggccatatcagccaatccagcacacaccaacccccat

SEQ ID NO: 1409 - DNA, 562 bp, Homo sapiens
tttttttttttttttttttttttctgctgtctccccaattctctttgtataatttctatgaagagataagctgaggtctgtcctgctgtattcccaggacccagcactgaacctaggaacagagcagagattctcaaaaagtatctcctgaataaaaagtgtttgtggtggtggcacctctagcagtcaggaactccctctttgcctctgagttttgatcctcaggcagtatttatgctggttaatgagtaattcttctctgggtttatggttcagagtagaataggagacctcaggcagcctggcaacctctggcctcgtgggaaatgccttccagtggaattgcggcaaatttcaactctaacccagggatatcgatctaggcctcattcccacacccagctctgctgccagaagcgttccaaggcttctcaggccccaagatcccactgctctcttcttcccctaatgctccaagaccctctcccagccaggccccaaaggctgtgcccccgactccaggttgctttcaagctgaagccacaccagaggaaagagctga

SEQ ID NO: 1410 - DNA, 563 bp, Homo sapiens
taggcttttatttttctctatgttctgcagtaactaaggaaaatcatggtaaatgtcaatcttcacacaacagcagacacaaagggtttcagaaacgtcagatatgaagaaatcccccatccttcttcaacattttactgggtatttcaacttcaaaagaacagcttatttctataagtgctgtacaagatcatagattatgatggaacgacttcattttagaacgttagcaaaactgttatactaaatgtcaatgacaggaaacaaagaaaaaaatttgttcaattatatttttaaacatattgttattctcaacaaacggaattttaaaacgaatacaattttccattatcaaaagcaaacactctatttcgcagttgaacaatgatcactgatcacaaatatcaaatacagtgtcccccgcccccaatcgacatcattttcaacttaggaccctggcatctactccttggggtacctgtgaccctcttttacacccccaagggtctgcctcagatctacttaaggggcggaataacccctagcacctgaattgaggatag

SEQ ID NO: 1411 - DNA, 627 bp, Homo sapiens
ttgaggggaagactgttaaccccatccacgccaccagaattagctctttcccttttggtttgcaagcactgcctgtaaagtcctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatgtgcctctgggcaaagaagcagagctaacgaggaaagggatttaaagagtttttcttgggcgtttgtcaaacctttattccctgtctgtgtgcagaggggattcaacttcaatttttctgcagtggctctgagtccagccccttacttaaagatctggaaagcatgaagactgggctttttttcctatgtctcttgggaactgcagctgcaatcccgacaagtgcaagattattatctgatcattccaaaccaactgctgaaacggtagcacccgacagcactgcaatccccagtttaagggctgaagatgaagaaaatgaaaaagaaacagcagtatccacagaagacgattcccaccataaggctgaaaaatcatcagtact

SEQ ID NO: 1412 - DNA, 616 bp, Homo sapiens
gtgtggcccgccatgttcttctccgcggcgctccgggcccgggcggctggcctcaccgcccactggggaagacatgtaaggaatttgcataagaccgctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacgccctgcatgcttcgaaactctgacagcatactggaggccattcagaaaaagcttggaataaaggttggggagactacacctgacaaacttttcactcttatagaagtgaatgtttaggggcctgtgtgaacgcaccaatggttcaaataaatgacaattactatgaggatttgacagctaaggatattgg

SEQ ID NO: 1413 - DNA, 252 bp, Homo sapiens
gacacgagggcccagtaatcagggctgtagtctttattatgcactagtgcatgtggctttgggcaaataactctgcttgtctggactccagttccttcactcccccaagtcacaaggttagccagaatgacctccagtcattctgattctgtgtctcatgatcagagtcacaggaatatttttattgagttgacaaaacgagaggatgaagggctgcaaggttctgtatgcacatgtgggtgcgtgtgcacc

SEQ ID NO: 1414 - DNA, 396 bp, Homo sapiens
ggcggcggaacagcttgggacccgaaacgcctcggcttttctgcggacccgcgcccggccgctgccgccggacgcttgagaagaggcagagtcttgctttgttgtccaggctggtcttgaacttctgagctcaagtgatcctcccgccttggcctcccaaagtgctgagactacagagagagaatgctaacgagctgtgaaatgaccaaagatctggcagcagaagggaaaagaaaaaataatggaatattttctgtctacaattggttgaatctgtggatgtggaaactgcagatacagatggagagccgactatactagctttttgtttcatttttcacttctggtgtgtgtgtgtgtgtgtgtgtgtgtgtgtgtgtgtatctgtgtgggtgt

SEQ ID NO: 1415 - DNA, 617 bp, Homo sapiens
catggggcgcgcgcgcgacgccatcctggatgcgctggagaacctgaccgccgaggagctcaagaagttcaagctgaagctgctgtcggtgccgctgcgtgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccaggactctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcag

SEQ ID NO: 1416 - DNA, 480 bp, Homo sapiens
atttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtagcgtagtagttgtctgctctttgtccatgtgttaatgaggac

SEQ ID NO: 1417 - DNA, 605 bp, Homo sapiens
tacggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacggaatgatcggtcgtggagctccagagatgattactcttgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataagga

SEQ ID NO: 1418 - DNA, 488 bp, Homo sapiens
cgggcactacatcgacagtacatctcactacaggtgggtcctccgatggattatttcaactgccacaatccattaaggggaggaggaggatggaagaaaccaagtgcttcatttttaactgaagcaaggtagggagttttattttactataaacagcacaaccgttaaatgtcttcattaagcaaactcacttttgagcccattttctgaccaacagtcctcaaagttcaaaatggaaataccctcccaacaaagcctgtttttttaaagacattgcaccactgaaatctcagcagctcaaccttcctgggtaatccagatactctggttactaagctggttacactggactctttctacaatctctgggagctcttcgaggtggttgtcacctgtcctctgtttcatttccagttcttcttttccctgacctgccttcagattctcctttaacttctacccttgacctgccttctgttttcaaatag

SEQ ID NO: 1419 - DNA, 558 bp, Homo sapiens
aaacggaagtggaagtgtcgttaatgcctccctgcttccataatgattgcggcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatgtgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtct

SEQ ID NO: 1420 - DNA, 589 bp, Homo sapiens
agtaataggagctcccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatagtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaggggttgggagctgatgaaactcacaaatgatggtaggaagaagctctcgacaatacccgttggcaaggagtctgcctccatgctgcagtgttcgagtggattgtaggtgcaagatggaaa

SEQ ID NO: 1421 - DNA, 605 bp, Homo sapiens
ggcaaaaaatcaaggtatttggtcccggaacaaagcttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacacaactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatc

SEQ ID NO: 1422 - DNA, 613 bp, Homo sapiens
cctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggccgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtagccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgt

SEQ ID NO: 1423 - DNA, 341 bp, Homo sapiens
cgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaagggtccctggttgtgaaaatacatgagataaatcatgaaggccactatcatcctccttctgcttgcacaagtttcctgggctggaccgtttcaacagagaggcttatttgactttatgctagaagatgaggcttctgggataggcccacaagttcctgatgaccgcgacttctagccc

SEQ ID NO: 1424 - DNA, 621 bp, Homo sapiens
  misc_feature 522: n = A,T,C or G
ttctagacactaaccaaggccaaccttgcaagcaggcctttctaagtatagcagcctcaggccttctgtggtaacctttttattgcacagtggataataatgtgaagctcagttttggtcttgttaagtgtaaagattcccaggacttgcagttggagtaggatagttggcagttgtcagcatgaacctggaacatgtaatatcagaaaattttgtagttagaagtgggaataggtaagaaggcctagggagggcatgtaaatccagaaagattcagcacacagatggaggcattagaagtgaagagactgttttttcttctaagatgatatggaagtaataaggtattttaaatatatatgtgtatatgtatataaagttataataagtttgaaggtagatggtaaggaagttggtggtgttggcatcctggttttgttgttgttgtttttaaacatgggagacagtgtcatcggatgaggggtagaagaagacaagaatgtcgtagagcatttaacttgnggaatggggcaaaggagatgacagagcttaatcaagtgaaagaattgcttgcagagtgaaggacctgaccttgtttctaacctctaatgctcttatctt

SEQ ID NO: 1425 - DNA, 558 bp, Homo sapiens
gctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccggggtatactacggtcaatgctctg

SEQ ID NO: 1426 - DNA, 605 bp, Homo sapiens
ttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtgatctattttgccatcatcacctgctgtctgcttagaagaacggctttctgctgcaatggagagaaatataacagacggtggcacaaggaggccatcttttcctcatcggttattgtccctagaagcgtcttctgaggatctagt

SEQ ID NO: 1427 - DNA, 578 bp, Homo sapiens
tctggttagaccccaatgagaccaatgaaatcgccaatgccaactcccgtcagcagatccggaagctcatcaaaggtgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctggaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagc

SEQ ID NO: 1428 - DNA, 566 bp, Homo sapiens
gccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttccggcttgccgggattgctgtccttgccattggactatggctccgattcgactctcagaccaggagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggc

SEQ ID NO: 1429 - DNA, 369 bp, Homo sapiens
atgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaagaaaaaaaaaaaaaaaaaaaaaaaattcttaaaaccaaccacccaaaaaaacaattttttttttcaaaaaattttttttggggccggatttgggaaatttgggcaaattaaaaaatttttgggggggtttttttaatttgttttaaaaaaaaaaaaaggttgggcccaaattttggtttttttttggaaaattttttaaaaa

SEQ ID NO: 1430 - DNA, 545 bp, Homo sapiens
agccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctgcacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgc

SEQ ID NO: 1431 - DNA, 561 bp, Homo sapiens
tgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccctgtgtggcttgaccccctgtggaggggagtgcctggtt

SEQ ID NO: 1432 - DNA, 581 bp, Homo sapiens
  misc_feature 457, 527: n = A,T,C or G
ggccgggggtggaaaaaggtaacctcaagttaaaagcccaagaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactgnacctctggtcctcaatcgagttcctctacgaagaacacaccagaaatttgtcattgccacttcaaccaanatcgatatcagcaatgtaaaaatcccaaaacatcttactgatgcttacttcaag

SEQ ID NO: 1433 - DNA, 634 bp, Homo sapiens
aacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaaacaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactact

SEQ ID NO: 1434 - DNA, 335 bp, Homo sapiens
tttttttttttttttttttttttttttcttcacgtgacttttatcaccatacaatttgtggcatttcctcattttctacattgtaggatcaagagtgtaaataaatgtatatcgatgtcttcaagaatatatcattcctttttcactagaacccattcaaaatataagtcaagaatcttaatatcaacaaatatatcaagcaaactggaaggcagaataactaccataatttagtataagtacccaaagttttataaatcaaaagccctaatgataaccatttttagaattcaatcatcactgtagaatcagagtctgtaattcttttcttgatt

SEQ ID NO: 1435 - DNA, 474 bp, Homo sapiens
ttttttttttttttttttttttttagtttaacttttccttttttgctgtctagtcatcctcgtcggtcttctgcttcttggtatcgacatcgtcatcctcatcatcttcagctgcccgcttgcccgtagctgactcagcttcctcatcttcatctccatcctcttcctcaccatcaccttcttcttcctcctcctcttcctccccaccttcttcctcttcttcgtctacctcattgtcagcctcctgctccccattttcctcattagcattcccgttagcaggggcgtctcttccattttctgcctcttccacaacttccttcttctcctttaagtccttggtggtgatttcggagctggtgtctacggctgcgtctgacatggtggggcacgccggtgatccgatgcaggggattaaaaagaaagcgagagttcagggactctggcgataaagctgccggagtccgcggcggc

SEQ ID NO: 1436 - DNA, 579 bp, Homo sapiens
gagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcctcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttgg

SEQ ID NO: 1437 - DNA, 638 bp, Homo sapiens
atggtctcgatctcccgaccttgtgatccacccgcctcagcctcccaaagtgttgggattacaggtgtgaaccactgtgcccggcctgtgtacaactttttaaatagggaatatgatagcttcgcatggtggtgtgcacctatagcccccactgcctggaaagctggggtgggagaatcgcttgagtccaggagtttgaggttgcagtgatccacgatcgtaccactacactccagcctgggcaacagagcaagaccctgtctcaaagcataaaatggaataacatatcaaatgaaacagggaaaatgaagctgacaatttatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggagtaggtaccatttgtgtctctttattataagtgagagaaatgaagtttatattatcaaggggactaaagtcacacggcttgtgggcactgtgccaagatttaaaattaaatttgatggttgaatacagttacttaatgaccatgttatattg

SEQ ID NO: 1438 - DNA, 280 bp, Homo sapiens
ttttttttttttttttttggacaggaaacacatttattgagagcacagtggggtgcgccaagccctgtgctttggaaccgcatcacagcgcccctcacaacagccctgtgaggtaggtgaaggagcccacttcccacatgcagacactgaaggctcaacagctcccctaggcctcagggttcctgcggggtgggcaggggtccagcccacgggtctgaccccaggtcagcggcgtccatcagtcagagggcgggtctctactcaaggggaggccccgggt

SEQ ID NO: 1439 - DNA, 626 bp, Homo sapiens
tttttttttttttttttttctgcatctcaatagaactagctttatttacttatttatttatttaaacaaaagaaatggtttaaaagcaaatgcatatatgtaccaagggatggacatgacctggtacttacaaaggagctgctgtgtcataatggaaacagcatattaggagaaaaatagtatttcgtgtgctgtctgcttgagtaatcaatctggagatgcaagttaaccgaaggtgctctgccaagccatcagcgtgagaaaaaaaaaccaccagaagttgcctccagataacgatgtagtggcagcatgataactggcatcaactcacggtcttctcattttccccattttctataattttcctcttctttcatctatttttttcttgaagatgttatttcggtaaaactgaagctctttgatgctttcactaatgtcatcaagtgccctatgagaagcagccttctttggtgcaaattcatattcttctggataccagcgtctgcacagttctttaacagtgctcacatcaattattctataatgaagatgtttcatgaactggggcatgaatttgtcaagaaacttcttatcttcatgaactgaatttcctgcaagtggac

SEQ ID NO: 1440 - DNA, 616 bp, Homo sapiens
ttttttttttttttttatttttaaccacaaccatgccttactttatcaaatgtataagaagtaaatatgaatcttatatgacaaaatgtttcattcattataacaaatttccaataatcctgtcaattatatttctaaattttcccccaaattctaagcagagtatgtaaattggaagttaacttatgcacgcttaactatcttaacaagctttgagtgcaagagattgaagagttcaaatctgaccaagatgttgatgttggataagagaattctctgctccccacctctaagttgccagccctctataaacctacctgtggagcaacctgctcagatacatcaaacatggagacagcactcaaagtagaattataaagaagatcatgtccatgttaacattattataaccctacattttgtgcataaagtgtaagtgtataagcatatcaatattaaaaagcaagcaagcagaatttggaattcatccaatccaaatgcggcatcttcaaacctccatgatgctgcttacatgtctcgatcccacttaactatcttgggctgtgacaaagtcacatggttcacacggcaggcatactcatctttttcagtgggg

SEQ ID NO: 1441 - DNA, 544 bp, Homo sapiens
  misc_feature 263, 316: n = A,T,C or G
attctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctangtgctggcccaccaccacacatcacaggctgatttccacaggcttcttcctangggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttgtattgaaaaataaaattaatttgttatcaggttgtttcagttgtattggatgccctatctatctgctaaagc

SEQ ID NO: 1442 - DNA, 493 bp, Homo sapiens
ttttttttttttttttttttttttttatttataggaaactttattttcattgatatttcacttaacataatttcaaagtcagtctgtggtctaagatgagcaaaagaacagatattgtaaatctcctaaaagactttttttcacactgctcctcagagcagggaatagggtttcagagccctgaaagctgacacctaacattatacccttgagatttacctacagatacagaaagaaaagataacatcaatatacaagaatcaagccctatgagggtcttattaagctcttgtgttacatactcgccacctctgtaggtttgtaatcatgactgattttccacctctctgccaagtttggtgtctttttttttaggtaaaatgtcagatgcaaaaatgctgcacttatttctcttaatatattgaaaatagtggaagatgcagatttttaattcttcatcagtctaagctggaacatgacttctgctaatggg

SEQ ID NO: 1443 - DNA, 505 bp, Homo sapiens
gaggaagactggacaaagggggtcacacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatgcccaaaatgctggccatcttctggttcaattccactaccatccagttagatgcttgtctgctacagatgtttgccatccactccttatctggcatggaatccacagtgctgctggccatggcttttgaccgctatgtggccatctgtcacccactgcgccatgccacagtactta

SEQ ID NO: 1444 - DNA, 504 bp, Homo sapiens
tttttttttttttttttttttgaaatttaaaataaaattttattttatcttatactcaagttcagacaatagcatgtggtgtacattcaaaatttttgacaggtacagagcacattaaaaaatgaagacatgatcaaggagatgtaagagacaaatagacaacaacattctccctgaatctggaaaaaagcaagcaataagatcacgaaaggcggctgtaaaacaggattattctgcatgtgttgcccacaactagggcaaggttatctctcatcacaagtacaaagccattgatgttagtgtgtaacagagagaaaacagaggatttgtacagctgaggaaataaatggcagatgttacacaggaagcaatataacatggtcattaagtaactgtattcaaccatcaaatttaattttaaatcttggcacagtgcccacaagccgtgtgactttagtccccttgataatataaacttcatttctctcacttataataaagaga

SEQ ID NO: 1445 - DNA, 602 bp, Homo sapiens
caggggctatatgtgccacctttcaggttggggccaaggaagtgatgtcagtgtgacagaagggagagttagacctccagacgtcagcctccctcccatggggtacattttcaatctgagtgttgttgccttagctgtgctggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctcccttcctgacgggaatgttgtgctataatgaatctgcataacgcttgggattctaggaggaaggaaggttccatggacatgtaagtacagcatattcccctcagtcttctaggagggcagagtgaatc

SEQ ID NO: 1446 - DNA, 635 bp, Homo sapiens
tcaggaggcgtctctccgagggtgtgggctgtgatggggccctgtgcacccatccaggctgcccagaccaggagagcacaggtcagccggacacatgatgacccagcctggcagctgcccgtgaccagtggctctggagccctcccaaggagaatgcagagagacgatggcgccacgccacgcccatccctccagaagcttccacggctcacacaggaggtgcagactgtaaagccggctttatccacctttacagcctcgtcctagacactcagtgtcaacagactcgaatgcctaaggtgcatacaatggaataggattaatctgtgaaaaggaagaaattctgacacatgctccggcgtggaggaaccttgaggacgacgctgagtgaaagaagccagacacgaaaggacagatacggcaagactcgacttatgtgaggtccctagaggagtcggattcatagagactgaaaggatggcgggcaccaggggcggtggagaggggaaatggggagttactgtttaatggggacagagtttcagttttacaagatgaaaagggtcctggagctggatgggggtgacggccgcacaacagcatgaatggactgaacgccactgaaaactgaactc

SEQ ID NO: 1447 - DNA, 399 bp, Homo sapiens
agtggagtgaggggtaacatagataacgaccgagtacggtggagctccataagctaaagcttgccgaactaaagcaagactgtcttgctcgtggttaggagaccaagggaataaagcaagatcttatccacagactccaggcatatcttagaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacacactgatagaatgcataagacggctgaacgattcaatgtacctgtgagcttggagagtaagaaagctgctcgggcagct

SEQ ID NO: 1448 - DNA, 563 bp, Homo sapiens
tagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctg

SEQ ID NO: 1449 - DNA, 561 bp, Homo sapiens
tacggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacgtactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaa

SEQ ID NO: 1450 - DNA, 389 bp, Homo sapiens
aaacatccaattctcaaactgaagctcgcactctcgcctccagcatgaaagtccctgccgcccttctgtgcctgccgctcatagcagccaccttcattccccaagggctcgctcggccagatgcaatcaatgccccagtcacctgctgctataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttccc

SEQ ID NO: 1451 - DNA, 490 bp, Homo sapiens
tacccgagtttttgattctcaacatgtccgagactgctcctgccgctcccgctgccgcgcctcctgcggagaaggcccctgtaaagaagaaggcggccaaaaaggctgggggtacgcctcgtaaggcgtccggtcccccggtgtcagagctcatcaccaaggctgtggccgcctctaaagatcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccgaggttaaaaaggcgggcggaaccaaacctaagaagccagttggggcagccaagaagcccaagaaggcggctggcggcgcaactccgaagaagagcgctaagaaaacaccgaa

SEQ ID NO: 1452 - DNA, 654 bp, Homo sapiens
  misc_feature 520, 602: n = A,T,C or G
tgaatcttttggttggtgattttgatgatagccacaaagcaagcagggtaatgctgatgcttcaagtcttggaaccacacttcgagaatcactgttataatgtacagcagaactgcatgatcagctgtatggtagccttgaaaaccaacaggccacaatcacagtgaaaacctcaggttggcagccactggagggtacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttcccatgcttgtcaaaaatcagaggcaactaacactgcggcttcctgagagtctcactctgtcacccaggctggagagcaattgcacaaacacttggctcactgcagcctcaacttcttgtcctcaagtgatcctcccaccttagcctcctaagtagctgggaccacagtggagacggngtttcaccatgttggccagtctgctttcctcctagcctcaagtgagccgcctgcctcgaagatgctttatttataagcgctntggacacactttaataaatgctctattgtatacagttgaactctatataaca

SEQ ID NO: 1453 - DNA, 399 bp, Homo sapiens
agatccaagcaaaaatccctggattgaaacgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatacctttttcctatctgaggcactggtggaataaaaaacctgtatattttactttgttgcagatagtcttgccgcatcttggcaagttgcagagatggtggagctagaaaaaaaaaaaaaaa

SEQ ID NO: 1454 - DNA, 534 bp, Homo sapiens
  misc_feature 459: n = A,T,C or G
gaagatgacccagatcatgtttgaaaccttcaatgtccctgccatgtacgtcgccattcaagctgtgctctccctctatgcctctggccgcacgacaggcatcgtcctggattcaggtgatggcgtcacccacaacgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggnagtccgctggaattcatgagacaacctacaattccatcatgaagtgtgacattgacatccgtaaggacttatatg

SEQ ID NO: 1455 - DNA, 536 bp, Homo sapiens
gtactccaggcgagaggcggacgcgagtcgtcgtggcaggaaagtgactagctccccttcgttgtcagccagggacgagaacacagccacgctcccacccggctgccaacgatccctcggcggcgatgtcggccgccggtgcccgaggcttgcgggccacctaccatcggctcctcgataaagtggagctgatgctgcccgagaaattgaggccgttgtacaaccatccagcaggtcccagaacagtttttttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatct

SEQ ID NO: 1456 - DNA, 469 bp, Homo sapiens
aaaaaaaaaaaattagtcggccgggggggggcatgcctgtaatcccacctactggggaggctgaggcaggaaaaatcgcttgaacctgggaggcaaaggttgcagggacccgggattgccccattgtactccaccctgggggaaaaagggaaactttgtcttaaaaaaaaaatgggggctgaaaaaaatggaggaattctgctctttgctctttaggggggccaaccctgcaaagttggggcctaatatttcacctgccctggtgaaacagtttactggccctttgttcccagccttttccttttaagtccatcgcccacacagcattggggagggggagccacttgaaacaaaagtcaacaacgggttgtagttcataaacccaaagctgttggcgccccctgtatctggaaggccattatgacccactactttttttttttcctaccccttttaaaactcagttcag

SEQ ID NO: 1457 - DNA, 531 bp, Homo sapiens
cttaactgtttcacgttcactattttaggttaattttcttgggaaatcaatttgaatattcccccctgtccttttgcattaaaggacgaaaatatatgttgagagtttgacagactttttaaatatgcctctttcccaattttatgtatttttggttctgcgcacacagatttatcaatgaagtacatttgcctctggctttatcacaaggaaaaaggaatcaaacattgaacacaaatgtgttccaaaccagtcttgtccatcttgtcacttttatgtgactgctcctctgaaccagaaggggcacgatagaaggccataggaatgaaagtaaatcattcaggtgaagtgagaaattcttccatatacagagtgaaaatgtgtgatttcattcctgccttcctttaaacgttgtcttgatctctgcctagtagtagttgagccctcagtcgcccaaacatgaggagagacccaactccagcagtcagaatttagtatttacatttgccttcccaagttgagaatagaatg

SEQ ID NO: 1458 - DNA, 528 bp, Homo sapiens
gtgttgcagcgcccgaacattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgccggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggag

SEQ ID NO: 1459 - DNA, 440 bp, Homo sapiens
tatattctgcatattttctcagtcatgataaacaggaacacttgaccagatcttctaccccacacagcatagataacatctcaaactcggtaaactgttattctaatagatttttttttttgagacagggtcccaccctgtcactcaggctggagcacaggggggggatcacagctcactgcagcctcgacctcctggactcaggggatcctcccaccccagcctaatgagtagccgggaccacaggcatgcgccaccacatccagctaattttttttgttgtttttggagagatgaggtctccctgtgttgcccagcctgttctcaaactctgggcttatcctcgggtctagcaattctcccgtctcaagggggttgggattacaggcatgtgccatcatgcccaaccataattctaatatattttaaaatatgattca

SEQ ID NO: 1460 - DNA, 489 bp, Homo sapiens
gacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaaga

SEQ ID NO: 1461 - DNA, 624 bp, Homo sapiens
tgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgcagactatggtttgtacaagaaagtttgtttgaatgtgtagaagaggaaaaagcaacaacagcaacaacacgaagatgatac

SEQ ID NO: 1462 - DNA, 623 bp, Homo sapiens
caatttaaaaacagtattgtctaatccatttattatatgtttataatgctatatattttttaatgtaaaaacatttgtaaattattagcctgtgccaaattgtacttgaattattttcagtctgccaagaatgtttcattctgtacttttaattaaaagactgtatatgaaaacccagaaaatatgaaatgtaggatatggaaatgatacagttctttaaaccaattatgtgtaaaaattcacttttttgaaacagcaagacagtatctcatgtgatattgtccctataatctaatttctataatttaatggaacttatggcctgtacatggtttactcctgtaatcccagcactttgggaggtcgaggtgggaggattgcttgagttcaggagttcaagaccagcctgggcaacatagtaaaaccccatctctacaaaaagaaggaagttagcgagcatggtggtgcatgcttgtagtcccagctacttcagagactgagcctgggaggtcgaggctgtggtgagctgtgtttgcaccttggcagtccacctgggcaacagagtgaaaccctgtctcaggtgggggttggagggagacagtaatggggctgggcgtgatggt

SEQ ID NO: 1463 - DNA, 543 bp, Homo sapiens
acctagggccaccagttcttgagcctttgtggattctcagattgcctctcaactttccctacttctggcttggaattcaactttttcaattctgctaaatttgttaccacttatctatctgctttttagcttgcaaaacattgttgcagttatatattttcctattctttgtctttgttaagctaattaagccattaaaaaagcatgttattaaatttacatatgtaaaaaaatttgtgatataaatatatgtctcatatatcatatattcatatatgaatatatgtcttatatatcatatattcatatatgaatatatattttttaatcccttggagctgggtgtggtatctcttgcctgtaatcccaatgctttgggaggccaaagtgaaaagatcatttgaggccaggagtttgagaccagctcgggcaacgtagtgagaccctatctctataaaatattttttaaaaattagctgggcacggtggtgcccacctgtggttctggctgcttgggaggctgaggtggcaagattgcttgag

SEQ ID NO: 1464 - DNA, 432 bp, Homo sapiens
tacggccgggcgcggtggctcacgcctgtaatcccagcacttcgggaggccaaggtgggcagatcacgaggtcaggagattgagaccatcctggctaacacagtgaaaccccgtctctactaaaaatacaaaaaattagccaggcatggtggcgggcgcctgtagtcccagctacttgggaggctgaggcaggagaatggtgtgaactcgagaggcggagcttgcagtgagctgatatcgcgccactgcactccagcctgggcgacagagcaagacttcatctcaaaaaaaaaaaaaaaaattatttgtttttaaaaaaaaaaccatgaggggtttaatttaaggcggggccaaatccaggggttaaaaaagtatattttggtttgggtctaaggcctttaatcaaaattgttttaaaaaaaaaaaaaaaaa

SEQ ID NO: 1465 - DNA, 530 bp, Homo sapiens
gattggaaataacaagtttcaggtcctgactttcctctgaatatgagctgaggaagaagtcatcttcatgggtcattctgctgcctcctccatcactgatagcatcgtgcacacctccagtcatgcgcctagcactgggactttggtgccactgcctcctccatcactgacaacatcgtgcccacctccatgcatgcgcccagcactgggactttgactagtgccgcctcctctatcattgccagtatcgtgcactcctccacgcatgtgcccaacactgggactttgtctgaggctgcctcctccgtcattgccagtatcatgcacacctccatattgtgcccagcactgggactttgtctgatgctgcctcctccgtcattgccagtatcatgcacacctccatattgtgcatacctccagtcatgcacccaacactgggactttcactgatgctactgcctccctcctgcaaagcacccatgtctgggaaaggcagagcctcagtaggatgaccatggaagctaata

SEQ ID NO: 1466 - DNA, 432 bp, Homo sapiens
cacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagat

SEQ ID NO: 1467 - DNA, 558 bp, Homo sapiens
ttttttttttttttttttttttttttttcgggacagagtaagactgtctcaaaaagaaaaaaaaagaaaaaagagtgttagggtcatgaaacacaaggtaagactgaggacctatcaatacaatgaaagagactgaagcgacatgagatctaaatgcaatacatgatcctagtttgtatagccgtcctctaaaagatattaaagtagtaacttataaatcttggaataggcccagatagttactttctgatataaagagaaaatataagaaacgtctactactttccattttgaaattttgcccactctaatgctgtaaacagacctaacagatcccagcactgctatactgagtaacgttggtttatcctctataaacatgatttgggaaaagtggtctgcctggaaaagctttgattattatataatcatacgagttagaattttgagaatactttatactttttcccctttatttgtacattggggagagaaattgcttttaagaatgaattattaagtctgtagaaagaaatataatatgaatgtaatgacaac

SEQ ID NO: 1468 - DNA, 338 bp, Homo sapiens
acatacgagactgtaaagatgtgacagtgtacattatatgacaatgcacattagccagcaagtcttttataggtggtttcagcagcaacgataaataatgcagaattcagctccagcactttatttcaaaagaaatttcctgcctccctccaagatgcagggtgaggaggtagcttggggttgctattggagaagtattcagtttgctactttgtgtcaccccttgccattcttttatccccagctaattattatctgcatataatataatctgctagaccataaattgacagctttcaggacagatgccttgaaagttcttagggaggttaaacaaa

SEQ ID NO: 1469 - DNA, 438 bp, Homo sapiens
aggcaactcagtcagtctctcggtgatcaggtctccacagacttcagaacaattttttattttatttttttagagatggagatctcacttcagaacaacatttttgggatatcagctttgctccctgtggattttattggtcctattgcacatggcttcactctttgtctggacctgccctggaaggcagggagagctccctccttttgagtaggtcacctgggaataagtgtcttccaaactggtttttctgctcagtcggagactgccatatttccatgtagaagttaggtcagggagaagcacccacagtcttggaaatccccaagtaacctgttgaaacgtgtattgccataggcaggagctatgaccaaaactgtggctacagatcagaaggcaatttagcgtagttccacacttacatgggtggaaaccttc

SEQ ID NO: 1470 - DNA, 422 bp, Homo sapiens
ttttttttttttttttttttttttgggacggagtctcgctctgtcgcccaggctggagtacagtggcagatctcatctcactgcaagctccgcctcctgggttcatgattctcccgcctcagcctcctgagtacctgggaccacaggcacccgccaccacacccgggtaatttgtatttttagtagagacggggtttcacaatgttagccaggatggtctcgatctcctgacctcgtgatctgcccacctcggcctcccaaagcacagggattataggcgtgggcgtgagccaccgcacccaatgcaggtttcaatttcatttctacccacagagttactcaagccagttgcagctgggtgtggtatcgcacacctgtggtcccagctactcaggaggctgagatgggaggattgctggaac

SEQ ID NO: 1471 - DNA, 524 bp, Homo sapiens
aatagcagcgtgcctatattttttgagctttttgtggaaactgtctacccagttccagaaggaattacttgtggagttgtcacttttttaagtaatatgtttatgggagtacttttattttttctcacattttatcatacagagttgacttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacat

SEQ ID NO: 1472 - DNA, 508 bp, Homo sapiens
gcggctggggaaggtgaacagtgtggcccgccacgttcttctccgcggcgctccgggcccgggcggctggcctcaccgcccactggggaagacatgtaaggaatttgcataagacagttatgcaaaatggagctggaggaactttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagttgcaactttttatacaatgtataatcgaaagccagttggaaagtatcacattcaggtctgcactactacaccctgcatgcttcgaaactctgacagcatactggaggccattcagaaaaagcttggaataaa

SEQ ID NO: 1473 - DNA, 545 bp, Homo sapiens
tttttttttttttttttttttttttttactttttttttttttttttttttttttttacgagcaagtatggtttattacggacaaatggtagaaaaatgttactaatatccatagataagttccttaagtcatgtagagagactgttattaaaagtttgctgcatttttctattgaatcaagaactagctaccagttacagtgccttctaaacacacagttagctttgctttatcaataaccaaataataaactaggtcccaatggttttgtccacatctaaattgttcaggtgatcaggaactcttttatttgggtgccttagcttttagttcttggttatatctccaaatacgaaaaagctgagaggctcctgctgcccccacaaagaaattaacagcaaacagactccaattttttggaataattacaagtgagtatcttgactaaataaaccctgtagccatcaaaacagcagattgagctgtgctaagtttttctgcaggtctggccatatcagccaatccagcacacaccaacccccatt

SEQ ID NO: 1474 - DNA, 562 bp, Homo sapiens
aagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctaggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctga

SEQ ID NO: 1475 - DNA, 646 bp, Homo sapiens
tttttttttttttttttttttttcattggattggtttaaaaattatcctggatccaggaaagtgatgccttttcttattctccttttatcatcaaaacaaacagccaatatgtctctagaaacattgcgttctaaactggaagtgctgacaagccttcatcccagaccctgagtggcagattttcatgaaaatcagcttctgggccagttaagtcttcatgaagttatcttttcataactcagccctcattcccctctgggtcagtagcagtggaaccaggaaacccaagggccagatttccttcctcaatgaaggcactccaggaagaaggggagttcctggcacctgcctgccaaactctgctctacttgctgaactttgctcagcatgaacagggcattctggctacaagttcccccaaactatcccagattgtatctttaaggcacaccaattcctctgcttaaggacttctgttcacaatgaattgtattagttattcttaacattcaaaagagaaagttctgcatcagagcccacccatgtccagccattgtgccctgagatcccaagactgtggggatgagggcagagcccattaacatcagggattctggtcactggggtcacacttgagcatgattt

SEQ ID NO: 1476 - DNA, 524 bp, Homo sapiens
cccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtg

SEQ ID NO: 1477 - DNA, 687 bp, Homo sapiens
tagtcacttctgattctgacaatcaatcaatcaatggcctagagcactgactgttaacacaaacgtcgctagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactg

SEQ ID NO: 1478 - DNA, 653 bp, Homo sapiens
gcagttgacaagcgactgtgacaggcctcgccggaggagctgggccctgaatcaccctgctccccggccggctgtcggcgctgggggagggggtcccgggggtcgactcaccgatctgcccgatgaactcgatcttgatgccctggtgctccagccgcttgttggggttcttgagggcaaggctcaccttcccggagaccgtctccccgtcgtagaagaggaaatatttctccttcttcccgtcctccgtcttgtgctcggcccgcttcctactctctgcatcgttcagaaggatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgccggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggag

SEQ ID NO: 1479 - DNA, 647 bp, Homo sapiens
agacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcccgctcattcagggagccacaaaagaagatgctgggtggtatactgtgtcagccaagaatgaagcagggattgtgtcctgtactgccaggctggacgtttacacccagtggcatcagcagtcacagagcaccaagc

SEQ ID NO: 1480 - DNA, 616 bp, Homo sapiens
cagtcatcaaagcgttccacgtttgaagttagcaactggcttaagttattgcccttattaaaattgctttctcaaaagtttgggttagtttcaaatgtgatattttggagggaagggaaagtaggtatctttcaggtcgtgataatgagctcctatgaaaggatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatg

SEQ ID NO: 1481 - DNA, 570 bp, Homo sapiens
tatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggag

SEQ ID NO: 1482 - DNA, 563 bp, Homo sapiens
aggcattgaggcagccagcgcaggggcttctgctgagggggcaggcggagcttgaggataccgcagataagttttcttctctttgaaagatagagattaatacaactacttaaaaaatatagtcaataggttactaagatattgcttagcgttaagtttttagcgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaaga

SEQ ID NO: 1483 - DNA, 167 bp, Homo sapiens
gacaagcgactgtgacaggcctcgccggaggagctgggccctgaatcaccctgctccccggccggctgtcggcgctgggggagggggtcccgggggtcgactcaccgatctgcccgatgaactcgatcttgatgccctggtgctccagccgcttgttggggttcttg

SEQ ID NO: 1484 - DNA, 80 bp, Homo sapiens
ctgcgcggacgccgtctcttcacagcgccgcgagcgccgacgcacgggttgctgctcggcctcctgaacccagtcccccg

SEQ ID NO: 1485 - DNA, 571 bp, Homo sapiens
gttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgttatgatctatgaatg

SEQ ID NO: 1486 - DNA, 641 bp, Homo sapiens
  misc_feature 520: n = A,T,C or G
agctggtatcagcagcgaccagggcaagcccctaaactcctgatctatgctgcatccactttgcaaagtggggtcccatcaaggttcagcggcagtggatctggcacagatttcactctcaccatcaccagcctgcagcctgaagattttgcaacttattactgtctacaagatgagacttaccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacanagagcttcacaggggagagtgttagagggagaagtgcccccacctgctcctcagttccagcctgaccccctcccatcctttggcctctgaccctttttccacaggggacctacccctattg

SEQ ID NO: 1487 - DNA, 554 bp, Homo sapiens
tcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttg

SEQ ID NO: 1488 - DNA, 549 bp, Homo sapiens
gtactccaggcgagaggcggacgcgagtcgtcgtggcaggaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaa

SEQ ID NO: 1489 - DNA, 539 bp, Homo sapiens
taacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacg

SEQ ID NO: 1490 - DNA, 536 bp, Homo sapiens
tcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaagtagccagccaggctggcatgactgcgccagggaccaagcggcagatcttcgagccggggctgggcatggagcactgcgacacgctcagtgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctaca

SEQ ID NO: 1491 - DNA, 333 bp, Homo sapiens
atgttccctgtggccctgggggctccatggtcaaatatgtgagtgtcacatcctgtattttatggtgagtcacatgttacaccagtgcacaataggctctgacgtttcctgcaataaagaggtctgttgaactgggcccaatccggcatttttcatgcttacttgaccatgagacccatattttgagaaagaaatactgacatcccaggatggcagtgttctgttaaagatacttgggaaatgttggctcatgggattacccttaattattaactgtagtgtaagaaaccctgtgatatccagcatacctcctttccagcctctgtccctccc

SEQ ID NO: 1492 - DNA, 585 bp, Homo sapiens
caggttgatatctgtgcagaagaattggggaataatgcaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatg

SEQ ID NO: 1493 - DNA, 580 bp, Homo sapiens
ggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtggga

SEQ ID NO: 1494 - DNA, 577 bp, Homo sapiens
gactataaatatgactatcaggttttcagattatgaaactattatactagcttagtgtttttaatgccaaccaactgaagaaaacatgattcgggtgtttttttctatgtattcatagcaacaataacacaatgagttcgatgctgccatcaatactaatgttactaattctcatggtattttactcagtggatttgaatgtggccatagaatctttctccacacaatatgccagacagccacgtataatcccatgagatttggtattcaatataaaactttacttttttactcaagttatatatattgccaccaccagcagtttttcagctaataaagtatacttatgatttaagtcacttggttaatgtcctcatccctaaagaatatgttaaaacgaatgcttaacttatagtagaagagattttcaatggcagtaatgaaatttccaaaaatgaaatttaatcatgcctcatgcacttctgtagtatatgtaagttttatttatatatcttaacgtaagcatttaagttattaagttatgactagttaaaaggaaatagtagcatagttaatt

SEQ ID NO: 1495 - DNA, 313 bp, Homo sapiens
aattacatcttctttaaagccaaatgggagatgccctttgacccccaagatactcatcagtcaaggggcgtacttgagcaggaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctac

SEQ ID NO: 1496 - DNA, 444 bp, Homo sapiens
ggcgaaattccgtctcaaaaataaataaaaaacaaaacaaaacaaagactggatagcagcaccaaagtttagcgaaatgtagaccacaacagctatttaacaattaatcctgaatgatagtaattaagttacacagaaagagaatgccggtgctagtagaagaggaggaaagaaacagggagagtgagggagagaaagagagaagcaaggaacattatctacctatggcttccatctatctgattcactaaggtcaaaaaaattctctcatatcaactaagaaatctaatgaaaccaatcaacactagcttattcctagcatttagctgtgctgaatgctgtagagaaataggaggcgaagtttttctaatttatagtttgatgaaagcaaattagcatgtgtgaaatgtgtagaagacattataagatggcgggcaataattt

SEQ ID NO: 1497 - DNA, 487 bp, Homo sapiens
tttttttcttttttttcgaggcagaaatcactgttaatcttacaatgggtacaagatccttaaaattttttataagcagtatagcctgagattctaatcatgactcagccagcacaatattactgaaccccaaggttgggataccccctcatagcctctgccacatccctatccccaccaaaatgtggtgagaaatgttcccactatagacatagcccacataataaatctggccttcagggacatggagttgagaacagggactttacagtgtggtgagcctggctcaggacagtaggaggcagaggttaaggcaaggggttgcagccacccacccagatcagttttgcagggcaaggaaataaaacagagaaaacagtcatatattcaggcaacataaatgtgggaacaaaacaataaacacctttattacatgggtgaagacaaaacaaggatttatttgcctttgcgggccttgattttccta

SEQ ID NO: 1498 - DNA, 517 bp, Homo sapiens
ttttttttttttttttttttttttagaatatagatgctttatcactgtacttaatatggtgtcttgttcactatacttaaaaatgcaccactcataaatatttaattcagcaagccacaaccaagacttgattttatcaacaaaaacccctaaatataaacggcaaaaaagatagatataattattccagtttttttaaaacttaaaagatattccattgccgaattaagaagaagataagtgttatatggaaagaagggcattcaagcacactaaagaaacctgaggtaagcataatctgtacaaaattaaactgtcctttttggcattttaacaaatttgcaacgttcttttttttctttttctgtttttttttttttttaagactgcctaattcagtttatagccattgtctgacaagagtagcaaaacattatcaataaatagtccttagtttgtacatcattttgttaaaaatgtttgatgtcatccatttttagtgctgcgactgtaaacg

SEQ ID NO: 1499 - DNA, 164 bp, Homo sapiens
cttgacatgtctttgtctgtatttgccattaggtataatgctggcctcataaaatgaattaggcaatatttcctctgcttctgtctttcaaaagacatggaagaaaattggtataattccttccttaaatgtttagtagatgcaacggcctacagcattatgct

SEQ ID NO: 1500 - DNA, 543 bp, Homo sapiens
ttttttttttttttttttttttttttttttagacaaagagggatttattttatttacaagaattctggagaaggatggcggctggtattggcctggtgaaataatgatagggtcaatgactctgtgattctcttggcctttttgtcatggtagcaaagtggctgctgtggctccaggcatcacaccctcaatcaaggtaggaagaagaggcccagggaggtgttagccatgcctgtgtcttttattggaaaagctttcccagaagcccaggtagacttcctcttcaatttcattggccacacctgatcacatagccatcctaagctgcaaaggagactggaacagtgaaaatctggatttacagcctccacagttggagtggctggagatacagagttgggacgacccctgaaaagtgaaccaaggtcgtctgcacggctgccctggagggcgtggtgcttgaggtcccttctacctctggggcttcatggaatgacttgttgcccccatggagcacctctggggaccactgggtgaatcccc

SEQ ID NO: 1501 - DNA, 510 bp, Homo sapiens
ttttttttttttttttttttttttttttgggaatatatatttagggaagatgttgctttgcccacacacgaagcaaagtaaataaagaccacaaatgttcaaattctaagccacttaatagcgttttgtacattaaaaatgacaagggtaattatacaagtagccttttaaaaaattctcacacggaacagctttgtatttagacttaaagctgttgctactttgctagtgacgtttgtgttaacagtcagtgctctaggccattgattgattgattgtcagaatcagaagtgactacacaagagcattagccagacttttcagtgagaacaggtaacaggctggcaccagcacttggtacagcacgtggacaggacgacggaacccagagttctctgtctctccttcacagcagatggactcttctataggtggctgttaatttacacaaagttatattccagaatcaggaagccccgcagtcgccaacacttgaaggagaactatgtt

SEQ ID NO: 1502 - DNA, 555 bp, Homo sapiens
ttttttttttttttttttttttttttgaagaagtaagcctttttttccttgttttgcaaataaaactggctaagttggttgctttttggtgattagtcaaagagaccaaatcccatatcctcgtccgactcctccgactcttccttggcttcaaccttagctggggctgcagcagcagcaggagcagctgtggtggcagcagccacaggggcagcagccacaaaggcagatggatcagccaagaaggccttgaccttttcagcaagtgggaaggtgtaatccgtctccacagacaaggccaggactcgtttgtacccgttgatgatagaatggggtactgatgcaacagttgggtagccaatctgcagacagacactggcaacattgcggacaccctccaggaagcgagaatgcagagtttcctctgtgatatcaagcacttcagggttgtagatgctgccattgtcgaacacctgctggatgaccagcccaaaggagaagggggagatgttgagcatgttcagcagcgtggcttcgctggctcccactttgtct

SEQ ID NO: 1503 - DNA, 498 bp, Homo sapiens
ttttttttttttttttttttttagggttgttgttgggctttttttgtttgtttgttttggtttttggttttcttgccgtggtgcaaaactgtagaaagttgcttactcactggccttggttccattgaagtctgcgtctcgagtgtccgtttcctcctcagaaccatctgcatttcaataactctacgtcctccagaccttctagaaggaacgaaagaggtctcgtttcctcgcctggtgcatcaccgcgaagtttcctgtggggggggccctctgagcttgctcttgagtgcgttcacctcgcggcccatggcctcgttgctctccgtggcctcatccagctcccgctgcagcttcctgcggttggcgttgatgcgctgggactcctcctctgcctcctccagctgcctcttgagctgcttgaccctggcattgcctttctctgcctgctccttgtactgctcggccatcttgcgctcgtcctccacctgcagcaag

SEQ ID NO: 1504 - DNA, 556 bp, Homo sapiens
tttttttttttttttttttttttggatactgactttattgtcaaatgtggaaatattttgttaaacaatactgagatgatagtagtacttagggtaagcattaacaatattattcaaaatgttatatagagttcaactgtatacaatagagcatttattaaagtgtgtccaaagcgcttataaataaagcatcttcgaggcaggcggctcacttgaggttaggaggaaagcagactggccaacatggtgaaaccccgtctccactgtggtcccagctacttaggaggctaaggtgggaggatcacttgaggacaagaagttgaggctgcagtgagccaagtgtttgtgcaattgctctccagcctgggtgacagagtgagactctcaggaagccgcagtgttagttgcctctgatttttgacaagcatgggaagatgggggctgttcatacagggcaagcttcaagtgtccagtcaaataaaaacatccttgcacgtcctttagggaactaccagcaggtcaaataatgacagttctctgggaatggggcattgaa

SEQ ID NO: 1505 - DNA, 537 bp, Homo sapiens
ttttttttttttttttttttttttgaaatgcagaaatatttattttggtttccttcattgtttttggaaattttgttttggtttataaaacatagaaatagccaacacttaaagcaaacattcaaaaccccaaggtgacaaattattgactttttgtgcaattaagaatacatatatgaagttaggctaccaagtagtgttattacaatgacaattctttagtgcaagccctgttgtgcttgtatataatacatgtactctcacagaccccaaaacagctgctttaaatgtacaaatgacagctcaattcagtcaaatgtggcaaagactcacaataaagtgaactgctgttaatttcccaaattaactttaaaaaatccctggagaagtgaatcccaggaaatgaactttccagatttctacatcctagaattttggcttgtcaaacacatttcatagaaatcaggtagcattataagaacatttgcttattactgtccatttcaataagtactcaagtatatactcccttaatag

SEQ ID NO: 1506 - DNA, 535 bp, Homo sapiens
tttttttttttttttttttttttttttctcaacttgtctctttgaatccaaaaccacttcggaactgggggctggtgtctgggacttgctgttaccaagcacgtttcccttcccttgtggcacctctgtgtgtggcaggcctgctgcctgcagcctgggctgaggctcactgagggcttggagctgctgtctctggtcgttgttttcactcaggtctctggaagctacagctacattcccctttttggtgacctcttctattcgctcctcacactgttccttcacctccttcatctgattgatgcactggctcaggtcgtaggagaacttcctctccaggttggtctggttcttctgaaactggaggacatcctgctgcagcctgccgtaattcctctgcagggtctttaactggtcttgcagcactcggatgagcctctcacctgtggtgatgttattcaccaaaaccgccttttcgtcctggtacagcttgttgacgctctccagctggaagttgtggctggactggattttg

SEQ ID NO: 1507 - DNA, 342 bp, Homo sapiens
ttttttttttttttttttttttttttctttttttttttttttttttcacagtataacagctctttatttctgtgagttctactaggaaatcatcaaatctgagggttgtctggaggacttcaatacacctccccccatagtgaatcagcttccagggggtccagtccctctccttacttcatccccatcccatgccaaaggaagaccctccctccttggctcacagccttctctaggcttcccagtgcctccaggacagagtgggttatgttttcagttccatccttgctgtgagtgtctggtgcgttgtgcctccagcttctgctcagtgcttcatggaca

SEQ ID NO: 1508 - DNA, 481 bp, Homo sapiens
tttttttttttttttttttttttttttttttttggagacagggtcactgtcacccaggctggagtgcagtggtgcaatcatggcccactgcagcttcgacctcccaggctcaagtgatccttccacttcagcctctcaaaatgttgggactagaggcataagccaccatgccaggcccattcaattctttatatgcgtcttacatatgtctgtagctggaaaatatacctgaaagcacaacattcatatatacagtatagcaaaacatggctgaggaaaaatctcaaaaatcacagcgctatgaaaccatgatcaccaagttcataaggccccagaatggtgctacaattttaatgtttccctaaaatgtttggtctcatctccctctaaacgatttcagtcttcttcactctcctcaaacctctaaactctctggtagaaactgcattcttaatacattaaatgtcttgatatggaaact

SEQ ID NO: 1509 - DNA, 398 bp, Homo sapiens
ttttttttttttttttttttttttttgctcaagcacagtttatgcaacaaaatgtgattcagaatctaatttcacaaaataaatccagaggagagacttgagggaaaagggcaaagatgtaactcaataaagtccatagcatcacagaataagatgatggtgatggtttctaaccttgagaatgtctaagtgggttcttcagtttctaaaatttatttatctgttcttgaacccaagaaatcagaatagatcgtaacagaaaaaaaatgacctagctttcacctagacaagttagaaaatgcagaagtagcctggcagaagtacaaccatctgacctttgacaaaaccacagaaataagaaagaaaaggctcactatgcgatgaatggcactgggata

SEQ ID NO: 1510 - DNA, 645 bp, Homo sapiens
tacggccgggtcttttaaagaggccgggaatacacatgactcaggtgctcttttgaaacgactacaaaagtctccattttgatcaaaacgttttctccgaatgaatggctccgatgctttctctttcccatcttaagtccccgctctgtgcctcagaatagtctgtgtccaagaaaataagaatcacgtcatctagctgtggacactgagcaaaaaggagcagcatgctattaagatggttgagacacacgagtgaacaaagatgggacaaactgtgcttcgttcaagaggtttcatcaagacccctaccgccccccgtccttcagctctgtacagtaactttagctttacatagagctgagataaaaataaagctttcttacaaattacatttttttccagtgaattacttttgcagtaaaaatagctgctacataaatccctcctgatctctgaaaaggagttgcatatttccaaaaataatattcttattttaatcacacagaagaacgtggagcacaggaaggaaatggctggctggtcagggagaggtgagctgtcggagaaacacagtaaaactaaaaaataaaatccattttgtgtataaactgacttaaacgcatgcaaagaagtggaaaacatatg

SEQ ID NO: 1511 - DNA, 575 bp, Homo sapiens
tacggccgggcattgttgagggaggaattatgtcctatgtgtttgtagtaacagaatccacagctaagaaaagacaagctcaggagggaagtccttgggtagatgctaaagcgccttctctttgttctttgtgccggaagctataggtttctaattatgatggcaggagaagtgtccttatgaagtgtgtcgctgtgtataaaaatatctctatgttttgttattgctgtgttctttgtgtgatagatgttattaggagcacactctgtcctttccaaggacgtaatctgactgttttctgtttcctcttcttttttgctttgctttccaacctgatgatgtgctgctgtgttctgttgcaatgaaattccttcatctgtttcacatcgcaacaaaaaggtaaggaactgcaaaccgtattaacatgctgaaacagcaccaacttatataacatgcaaaaggagatgcattttaatcactgggaatttttttactttaagagaaaaagtgatggattgtgaggacctcaattctcgtattggtgtttggctgatggatttcacatctcctggggc

SEQ ID NO: 1512 - DNA, 424 bp, Homo sapiens
agcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccggtgtacaaccatccagcaggtcccagaacagctgtcttctgggctccaattatgaaatgggggttggtgtgtgctggattggctgatatggccagacctgcacaaaaacttagcacagcccaatctgctgttttgatggctacagggtttatttggacaagatactcacttgtaattattcc

SEQ ID NO: 1513 - DNA, 561 bp, Homo sapiens
tctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaacctcctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatc

SEQ ID NO: 1514 - DNA, 592 bp, Homo sapiens
gggaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaata

SEQ ID NO: 1515 - DNA, 552 bp, Homo sapiens
taactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggct

SEQ ID NO: 1516 - DNA, 564 bp, Homo sapiens
aaggaattggcgatgttttatggaacctacacaattctcatcaaacactaatcttcaccgggtctatcattattgtttttgttctgtaattgctatttcagatgcttcccttaaagataatattggctaatattcataaagtagttttccaagatgaaagttgagagcttcatctctgcaggcacactgcctagctctaaatccaaagtccatcccatactgctacaggaatttaaacaagttacttaccttcctcaagccttgattgcctataaatggagatactaatggcacctaccctgcagaattcatgtgaggatggaaacatataatctatgcactatgcttagcagagtgtctgtacagaacacacactgttaaatggtaactgttattaccatgattagtttgcaaagcactttcacgtatagttgctgcaaactaatgtgcactattttgttgtcatttgccagatagatcattaacacattattgtttcacctcaatccctccttatatgttaaatctaaatgttattcaactacaaaattttaaaaatatctg

SEQ ID NO: 1517 - DNA, 542 bp, Homo sapiens
ataaattctcattgtatcctcccatctgtccactgaggaagattatcaaacggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccttttgatttcaaattaatcaggaagaattagtgattttaatgagcagtaaagtggtgcaataaagcagaaagaaaaatgttcagccagaagtgaaagactagtaaaaaaagaaaaaaaatatttgtacatatgatctaatttagaaagtccagaattggcttcatacagaaaagtgattactttcattgtacaaattactttaaaattttggtaaagtttctgttaggcttctggtctac

SEQ ID NO: 1518 - DNA, 665 bp, Homo sapiens
agtggtgcacatcagtagtcccagctactcaggaagctgaggccagaggatcgcttgagcccacaaggtcgagtctgcagtgagccgtgatcaaaccactgcactccagcctgggtgacagagcgagaccctatctctaaaacagaaaataataggactgttgggccttggcatagctccttttcttctatgcacaaagagacagcttcatacaaaagagaacacagtgaccacccagagaatagtaaccttatcctcttttcctctttgatattgttcagaggatcatagatgatactggttaaaatgctcaaagagcctctggatcatccgagacagactcacagttcttggtcctcttcctccaggcctcattgtcttactgcttccatgttaaagcacccagacccttgtccagaacttttatagcaagataaaagatcccttccctgagcaacttcctcctgctttgggacacatcttccctcagggcacaatctgtcagacactcgctcgcctggcctgctgtctcccctcccggcctgatgttggatttcagtaggttgcagctaatgttgaatatatttcagatgctgtaccctctctgtgaactatgaagacatgattagcagatacaattagctactttagcattaaaaaaaaat

SEQ ID NO: 1519 - DNA, 575 bp, Homo sapiens
acatgttattgtcagttttgaagaaactacaacttaatatgtgtggcttatgtactaggcattcctgacttctcatcgagtgcctcctgtgacttgtcctaccttttcctccaaaactaaaatctaattattcttaacaaacatatcctgtatgcctttttcccaccaagttttctgaagaattgtttttattataattatttagtgctttattaaagtgggcaattaaagcattttaaatgcctccatcatcaatctatatgtttatcttatgaggcattaacaccactttacttttatacagcagtttgcagtttacagcttgaaacatgtgtaccccaaaaatagcacattgccttttcatcagaatagggatatctaatttaacaatagtcaccacatacagtgaagcagtgagaagactggccttcaaaccagtaatcttcattttctacggaagtgcccaagcctggctttcctctttgcctttatgcagttggaccattgagttcaccagattgcaccccaaactccattattttgctttgagcaaggactgagagttagtgtagact

SEQ ID NO: 1520 - DNA, 694 bp, Homo sapiens
  misc_feature 108, 128: n = A,T,C or G
gccggggcccctcgttatagaaatttctttcatagtatttatcccatgaaacctgtgtgcaacacagcagaggtccaaagtaggtaagtacagatccagaaaagtcantggaaaatagggccaatggngaaaaaaaacccctaatcattgaccaggccatcaagctgtcattagtgactttgcaggatgtgttaaagaggcctcctattcatctcacaactcaaaacagacatgctctccgggaaagtggcctgatattcatgttgatgccttgacttctcccagtgcataagcttcccacttgtcattggatgatcccaaattcactgttcctttaatgccattgaattctgaccatagggagcaccaatggtagcttcagcttccctgaaacaagcttcccgttcctgaatttcctctcactcttgagtccaggcccaggtgcctgagagaggcatttgccacagctggccatacagttgactttatcgagtcaacatctgtttctagagggcacagcacttagccccaggactcagcttggtgcccaacgctgagcttccagttattgcaccgctaggggcaaatgatgtttttcttcctatccagtgaagtgggctcctatttggcaaggaaggaaaatgaacaactttaattccttcctaacttttttcataacaactctcttaattct

SEQ ID NO: 1521 - DNA, 566 bp, Homo sapiens
  misc_feature 111: n = A,T,C or G
tgttacatagagggaaaaggactgggatagaggacagactgatagtttctttctttcatatcacacgtatagagaaataattatatcagaaactcacaaacctagacatgngaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgacctgggagttggaagttgcagtgagccgagatcgcaccactgcact

SEQ ID NO: 1522 - DNA, 609 bp, Homo sapiens
ccgagcttgcggcgaccacgagcaatggactcttgtggctgacttcactcaccatgctctcactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcatagaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatga

SEQ ID NO: 1523 - DNA, 555 bp, Homo sapiens
  misc_feature 487: n = A,T,C or G
tctactttttcccttatttgaattttttgtagtggaagattccaaagacattcaaaaatttaaaaagaaaataaatattacggacccccatgtagccattgtccagtttaaccagttatcagcgtttagccagccttgtttccttagctctgcctgtccctcttgttctggaatactttaaggcctgtcctagacaacacgtcacttcactcatccatacttgaacatgtgtcctgacagatgaagactgtaaagaatataatcatgtggtgctgccatcagagccaaccaaattagctgttcattcctgatgtgacgattgggcctaaggcagccttcctcagcctcagcactgttaacgttttgggacagatgattctgcgctgtcggggcagccctgtgcattctagggtttcagcagcacccctggcttctacccactgaagccaatactagctccccaagttgtgacaatcaaaaatgactntttgggttgggcgccacagctcacgcctgtaattccagcactttagaaggctgaggtgggaggatcgc

SEQ ID NO: 1524 - DNA, 562 bp, Homo sapiens
cagcactctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggatccatcagtgacgttggtggtcataactttgtctcctggtaccaacaacacccaggcaaagcccccaaactcatgatttatgatgtcactaatcggccctcaggggtttctagtcgcttctctggctccaagtctggcaacacggcctccctgacaatctctgggctccaggctgaggacgaggctgattattattgcagttcattttcaggcaggagctctctcgggctatttggcggagggaccaagctgaccgtcctaggtcagcccaaggctgccccctcggtcactctgttcccgccctcctctgaggagcttcaagccaacaaggcccacactggtgtgtctcataagtgacttctacccgggagccgtgacagtggcctggaaggcagataacagccccgtc

SEQ ID NO: 1525 - DNA, 488 bp, Homo sapiens
cgcagggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaat

SEQ ID NO: 1526 - DNA, 563 bp, Homo sapiens
aaatgaattacaacttaaatacatgttggaagtgtaacactgtttttcaaggtttaaaaaaaattcctaatgccttttagccttctttaatatttttaggtaaggaaagtatgtttggattttttcctctttgttaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaagtggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtga

SEQ ID NO: 1527 - DNA, 445 bp, Homo sapiens
cctgcaacttccctaaaaattgaatgaattgtaaaacagacctatggaatttcaaacctgaacaatcagggggacaacttcttgggactttgggtattctgaaattactcatcttgactctactgggcctggatgtacctgggtgttttgggggtatcctgttcatggccaatgggggcagagtctacataaaactatgcttcggggggttctggggaaaacctttcgacttgttggctatactattcaatatggctgtatagctcattgggcttttgaatacgttgggggggttgccatgtgttctggaccatcaatggagcctacaattcaaaattcaaatattgtctttgcaaaaaatcttagtcgacatttttatggtatccaaagaggtgacattgtgattgcaaaaagcccaagtgatccaaaatcaaatatttgtaaa

SEQ ID NO: 1528 - DNA, 558 bp, Homo sapiens
tgtgggcagctgaggccactggcgtgtctcagccaggcatctggggggccagcggaaccaggggccagcagggctggtggcagaggcagcactcaggttggccactgggggcctggccaccctcaggggtggccctctgaggtctcagggctgcgtgcctgtagggagtccactacccccagcccagggctgcctgctggcaccgtggcaaggcccaacctgaggggcttgcagggagctggcagcaggcttggaggactgggtctgtggggcagtgtggacacggcagagtgcaggaatgtgctgggaggaagtcagacagccgcgagatgaagagttcgtgcaccccatctgagtgcctggcccagggcctgaaacccgccctcaggggcctctctcctgcctgccctgcctcagccaggccctgagatgggggaaaacgagcagtctgctctgctgctctgaccttccagagcccaaggtcagggaggggcaaccaactggccccagggggatatgggtcctctggggccttcgggaccctgggcaggggtgctt

SEQ ID NO: 1529 - DNA, 572 bp, Homo sapiens
tgacagcattcgggccgagagtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctg

SEQ ID NO: 1530 - DNA, 578 bp, Homo sapiens
ggagcggcacctggaagatgcgcccattggctggtggcctgctcaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagct

SEQ ID NO: 1531 - DNA, 557 bp, Homo sapiens
ctcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatact

SEQ ID NO: 1532 - DNA, 583 bp, Homo sapiens
gtttgagtcatgagcatgctgttgtctagagtgggcggggatgacgtggttggagtgggtgcgctgctctgtacttgatttttttgagtctgaaattagctttccaggctggggcagggaggggagcacaggtggatcagtactgcccccaagcggtggagctttggtggtggatcaaatactgctgccgcctgtctgcacaaacatatttctctcttccagcccttcagaagtgtattggaatatgtcgataacaataatgatggtggtgaagatgatgatgatgtgggtaattctggctaccttattgggtccaagctccccacaattcgttgcacaaagcactctacatacattctctttagtcctgatcaaaccacctttcagagtaggatttagtgtcctattttaaagatgaaggagctcgggctcagagagagatcgtttagacacacacacaactttggaatgaaacatttacagccgggcgcggtggcgcgtgcctgtagtcccagctacttgggaggctgaggctggaggatcgcttgagtccaggagttctgggctgtagtgcgctatgccg

SEQ ID NO: 1533 - DNA, 569 bp, Homo sapiens
gccggggggcttcctgagctgacagcattcgggccgagatgtctcgctccgtggccttagctgtgcgcgcgctactctctctttctggcctggaggctatccagcgtactccaaagattcgggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgagtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgc

SEQ ID NO: 1534 - DNA, 66 bp, Homo sapiens
ctttaacctccctttctcagaaactgctttatccaggctcgaatagtataattaccatatgtcaac

SEQ ID NO: 1535 - DNA, 560 bp, Homo sapiens
tacggccgggaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatgg

SEQ ID NO: 1536 - DNA, 287 bp, Homo sapiens
gtatataaagcaaagaacaacacagtcacttcctggcggcaaaccaaacaaaaccagagtcatctggggaaaagtaactcgggcccatggaaacagtggcatggttcgtgccaaattccgaagcaatcttcctgctaagggcattggacacagaatccgagtgatgctgtacccctcaaggatttaaactaacgaaaaatcaataaataaatgtggatttgtgctcttgtatttttaagtggattaaaaaacttactacctgaaaaaaaaaaaaaaaaaaaaaaaaa

SEQ ID NO: 1537 - DNA, 113 bp, Homo sapiens
tttttttttttttttactaaacgagaattgactgtttattcgtgcaaaaaaaaaaatacttgctgttactgcaatccacccactggtctggtgggcggccagccatttatctc

SEQ ID NO: 1538 - DNA, 434 bp, Homo sapiens
tttttttttttttttttttttttggcgtggtgttaaacaatggttttgttctctgccttataaattgtgggattctagaggagtctgcttttctcccaagaagtacctcttcttttcttgcttttcatatgctctccttgagatatcttggttattctcatggctttaaatagcacttatatccagaagactcataaatctgcaatctaattatggcatctccagagttctgtattttaaaagttagcagaatctttaacgctgtggcaaagtttctggttttaagcgtaaaggtagtaatgagacatgaaaatacagtgaagcaatcaaacctgtaatttagaaaaataattgacagcattttggagaacaaagctccttgctgcatgtggtgaataaaaagtaaataaaatactgtggctacccctgaggga

SEQ ID NO: 1539 - DNA, 525 bp, Homo sapiens
aaatgaaatattgtcaagagtttcagatagaaaatgaaaagcaagctaagacaagtattggagaagtatagaagatagaagaatataaagccaaaaattggataaaatagcactgaaaaaatgaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaag

SEQ ID NO: 1540 - DNA, 461 bp, Homo sapiens
gtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttaacgcaggttgacaactacaggcacaagccattgaagctggtatgtcctgttgctggtatttcaattgacttaagccaactatcccttcagttacaataggaaagtgcctctaataaggccaaatatgcgtactaacttgtagcgaccacgtgtccgtgcagtgccacaggagctagagcagtgacaatgctggtggcaacagggcagtgtagcaggtgcttcatgttcaccttttcaaccttttcatttaattgtcacaactcggaggtggattctgtt

SEQ ID NO: 1541 - DNA, 540 bp, Homo sapiens
aaggaagggctgtacagttgatgccaggcaaaaacaggcacatatgtgtgtcttctgcctctccccagatcctgtacttcaccaatggccatctgtatccaactggttctaagtcaaagcgggtcagcctgcttcaaaacccccccacagtgggggtggccacactgaaactgactgacgtccacccctcagatactggaacctacctctgccaagtcaacaacccaccacatttctacaccaatgggttggggctaatcaaccttactgtgctggttccccccactaatcccttatgcactcagagtggacaaacctctgtgggaagctctactgcactgagatgcaactcttccgagggggctcctaagctagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccacatggcagtgcatcctgtgagctgac

SEQ ID NO: 1542 - DNA, 517 bp, Homo sapiens
acaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcagaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgag

SEQ ID NO: 1543 - DNA, 326 bp, Homo sapiens
acatgtctttttttttttttttttttttttttttccgagttttatgatttatttaacttgtggaacaaaaataaaccagattaaccacaaccatgccttactttatcaaatgtataagaagtaaatatgaatcttatatgacaaaatgtttcattcattataacaaattgccaataatcctgtcaattatatttctaaattttcccccaaattctaagcagagtatgtaaattggaagttaacttatgcacgcttaactatcttaacaagctttgagtgcaagagattgaagagttcaaatctgaccaagatgttgatgttggata

SEQ ID NO: 1544 - DNA, 574 bp, Homo sapiens
tttttttttttttttttttttttggccattgtcataattttttattatgtatcaaattgtcttcaatataagttacaacttgattaaagttgatagacatttgtatctatttaaagacaaaaaaattcttttatgtacaatatcttgtctagagtctagcaaatatagtacctttcattgcaggatttctgcttaatataacaagcaaaaacaaacaactgaaaaaatataaaccaaagcaaaccaaaccccccgctcaactacaaatgtcaatattgaatgaagcattaaaagacaaacataaagtaacttcagcttttatctagcaatgcggaatgaatactaaaattagtggcaaaaaaacaaacaacaaacaacaaacaaaacaaaacaaacaaacaaaaaatcccaccaatcttcatgggtaaactttcctgctcagggatgtaagctgactctagaccatcccgcggttcctgcggatagcacagcacaagatcatactgaagatcatgccaaatatcatgaccacggcaatgccgatgcccactgcgccgatgatgtggaatttatt

SEQ ID NO: 1545 - DNA, 573 bp, Homo sapiens
attggtgtttctactgtaatgcattttggaacaattgtctttggcaagtcagctaactctcagtgcttcagaaatgttcctccgtgattaccaagccaatacacatgcctgaataatgagagatgtgttactgaatggctgataaagattgacaagggaatgcaaggagcaatacacagtatgctcttgccagtagataattggtctgcccacaacatactcccacacttggatcatgtaggggttgagtttttcccattgaactacacagccattctgcagccattggatcagggtacagttggcacagtgacagctcacttctgaaagcagttggaacaactctttctaaatgtagagtatgaagagaaaaatggagaaaagcaacatgagtaagccattgacatgattgcagagacttggtgatctataaagttatctgtaatcatgaaatgttagcaaaacacaggcatgattcctgtggagtcccctgaggtcctcctgtaagaagactgcaactaaatgtggtatttgaaccaatctagcactcaactgctgctgtcattgatgtct

SEQ ID NO: 1546 - DNA, 559 bp, Homo sapiens
tggagctgccagagtaaagcaaagagaaaggaggcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagttgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccatta

SEQ ID NO: 1547 - DNA, 544 bp, Homo sapiens
tttttttttttttttttttttttaaaggggcaaaggttttattgtaattttaagttaacagcattaaaaagaatcaacacaattatactgttaataaaaagacaaaaagacttcagcatagaaagtgtcatttacagaaactacaatcatacaaagaatattttcttacacaccaaatgaaaaatctaaacattaataaagacttcttatattctaataattagtgggacctgacagaagcatcagtgaaatgtcatcaagactatgtgtgaaaattagacaagatgcgcacaattagcttcatctcagcaatatttagcaagagaccttttggtacaaccaattaggcaacatttctcaaacagtgccacgtagggtcgtctctttttttgagaatgagtatccaagcctaagtattttaattctgaaggattgctgtctgcggcttcactttgcctattgcgaataagtttcttaaattcttcaaagctaagattggaatcctttaatgcaggtacatactgctgtagctctggtaatgatg

SEQ ID NO: 1548 - DNA, 554 bp, Homo sapiens
agaaggtgggtggtcaagagcagagcttagggatttagtcacatatattacgttacagagacacagaccaacattgagtaaccactgtgtgcctgatctttaagtcatgcattttgaaatgtaaagacagagtctgtatgtgtttatatttcttcttccaatttctctacagctttccttacaaggttgagtccacatcagggctcagtgttggctgaggtggggtgtccacaaccctactcctagtctttacagtatatgtgggttgaacacccccagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagt

SEQ ID NO: 1549 - DNA, 628 bp, Homo sapiens
taccgggttaaaaagtttgttaactctcttttccggctgggaccatggagggtgttgaagagaagaagaaggttcctgctgtgccagaaacccttaagaaaaagtgaaggaatttcacagagctgaagatcaagcgcctgagaaataagtttgcccaaaagatgcttctaaaggcaaggaggaagcttatctatgaaaaagcaaagcactatcacaaggaatatatgcagatgtacagaactgaaattcaaatatcgaggatagcaagaaaagctggcaacttctatgtatctgcagaacccaaattggcgtttgtcatcaggatcggaggttatcaattgggtgagcccaaaggtctgaaaggtgttgcaacttctttgccttcatcaaatcttcaatagaaacttgtgaagctcagcagggcttcaataatgtgctgaggtttgtagaaccatatattgcatgggcatacccaaatctgaagtcagtaaataaactaatctacaaatgtggttatagcgaaatgaataagaagctacttgctccaacagataatactttgattgctcgatctcttggtaaatatggcctcatctgcatggaggatctgattcatgagatctatact

SEQ ID NO: 1550 - DNA, 239 bp, Homo sapiens
tggtcatctctactaaaaaaaaaaaaaccggggggggggggcatatccctgtatttccacctcctcagaaggttaagggggaagaatcctttaaccctaaaaggccagaactgcagggacccttaaccttcccttttttttcaaaatggggggaaaaagggaaaccttgtttaaaaaaaacccctccaaacccaaaaaccccccaaaaaaccgaaaaaaaaaccccccttttaaccaaa

SEQ ID NO: 1551 - DNA, 631 bp, Homo sapiens
tacggccgggattcatacctaatttaaatgacaatttatcctctaagtcaaaaaaacactgttgtagttaagaatgggaatatttcagctacttcatatattgacatttttttgaggatgacagtctggtgattaatgaattccaagtgttgctctagtgctgctttccaatgtactttgagagtatttagtgaatgctgtagaaagtaccacattgtttggctataaaaagaaacattgttcctactttttaagaatatgtgagtggggcaacataccagctatttctggttgaagcaacttcacttagtgatagtttctttcaaatgcagtaatatatgaaagattataaaacactgtggacttttatgttatttacttaaaattttaaagtttttaaaaaagtaatagtgttgtatttttttaaagggcctaaatgcttaaaaaatctagttaaacttacactcttccttggaaaactgaactttaaaacaaagaagtaaggaaataatgtcaggctagctaaaggaagtaccacaaaattcaagtatgtttcttaaaagacactaacagacgtttgttcatgccttatcaatttttatttaacatttaatcctaacatgtagctatt

SEQ ID NO: 1552 - DNA, 616 bp, Homo sapiens
gccagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgcgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatgggtgtatacctagaggactc

SEQ ID NO: 1553 - DNA, 607 bp, Homo sapiens
acccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcgcctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctag

SEQ ID NO: 1554 - DNA, 524 bp, Homo sapiens
acagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataagggaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatctt

SEQ ID NO: 1555 - DNA, 574 bp, Homo sapiens
aggcattgaggcagccggcgcaggggcttctgctgagggggcaggcggagcttgaggaaaccgcagataagtttttttctctttgaaagatagagattaatacaactacttaaaaaatatagtcaatgggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggag

SEQ ID NO: 1556 - DNA, 631 bp, Homo sapiens
gcgactgtgacaggcctcgccggaggagctgggccctgaatcaccctgctccccggccgactgtcggcgctgggggagggggtcccgggggtcgactcaccgatctgcccgatgaactcgatcttgatgccctggtgctccagccgcttgttggggttcttgagggcaaggctcaccttcccggagaccgtctccccgtcgtagaagaggaaatatttctccttcttcccgtcctccgtcttgtgctcggcccgcttcctactctctgcgtcgttcagaaggatttccacctccacgctctgcccgaagccgaagaagctcatcgcaccgccgggccgggcgggtctcggaacgactcggcgcgcgcgcgggagcaagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatg

SEQ ID NO: 1557 - DNA, 656 bp, Homo sapiens
tacagatctggtctgaatctcaagtccagaccagtcagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcagatgaataaagcaaaatgcatgtgttgacagctgttgtgatacctcagttcttgtcttcttggtttaaaagaatttaaatgagacagcaaaggagatgcagcataatttattgcaaaagaaaaggagtattttgaaagttaggtgcagaacagacagtacacctgagagagagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagct

SEQ ID NO: 1558 - DNA, 584 bp, Homo sapiens
tacggccgggataactgggccaagggccactacacagagggagccgagctggtcgactcggtcctggatgtggtgaggaaggagtcagagagctgtgactgtctccagggcttccagctgacctactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctatatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgccctttcctcgcctgcacttcttcatgcccggcttcgcgcccctgaccagccggggcagccagcagtaccgggcgcccacggtgcccgagctcac

SEQ ID NO: 1559 - DNA, 633 bp, Homo sapiens
acgacgcccagaatgggagctgactgatagggtggtgtgggtgactggagcctcgagtggaattggtgaggagctggcttaccagttgtctaaactaggagtttctcttgtgctgtcagccagaagagtgcatgagctggagagggtgaaaagaagatgcctagagaatggcaatttaaaagaaaaagatatacttgtttcgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagagcttgccacatacccaggtataatagtttctaacatttgcccaggacctgtgcaatcaaatattgtggagaattccctagctggagaagtcacaaa

SEQ ID NO: 1560 - DNA, 524 bp, Homo sapiens
cagacccttggactaaggctatagtttcgacactgtttccaggtgtccacattgaattaaggatctgaaacaaggcttcagaccacctctccaggaaagtgcacgtttgcaaaggcttgaccacaggttctgggggcccacagcccccacgggtgaaacaaaccccttctggctctgacagccagcaaaactctggggcctgtctctagggacatggcagaggccccacccctctgcccagttggccttgctcttgggactgcccaaccacaaacagatttgtggtctggtaacaaaaaaagaaaagacaaggaggccggcaaaagtgggaggctggagggtgggttaaaaagaggtggaaaggccaagaaagcaggctgaggggaagacttctgcctctgcagacactgtcccctcctctcctctgtgaaaggctcccctggaaaggtggttcttcagtaggtaaaccatccgctggatggagctgcaatgcctgagctgaaagggactgtttacgcgggcgt

SEQ ID NO: 1561 - DNA, 353 bp, Homo sapiens
tggcacgttcccctaatcccaactactcgggaggctgctgcggagcccccgcggggcgtttggtttcggtttggccctgactgggattattgttgacgatcgaaatgggagtccccaagttttacagatggatctcagagcggtatccctgtctcatctaagtggtgaaagagcatcagattcctgaatttgacaacttgtacctggatatgaatggaattatacatcactgctcccatcctaatgatgatgatgttcacattataatttcagatgataaaatctttactgatatttttcactacctggaggtgttgtttcgcattattaaacccaggaaagtgttctttatg

SEQ ID NO: 1562 - DNA, 465 bp, Homo sapiens
gtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagttacatggggcagctgctgcagtttgagacccaggtgctgtgtcactgaggtggtgcccctctgcctgcctgccccactgtgctggcaggagctgactgtggactggtgggctcccctctgggccagcacagtccccttacctctggcagggctgctacctcctcagagtttcagaagcccccacatgggggctctaggaatgccggcatgctggtctttccgacctggcgctcttctgctgggggactgaggctggccctcattc

SEQ ID NO: 1563 - DNA, 513 bp, Homo sapiens
atatacttaggtaaatatagcaattttgaaattggaggaattttctgactaaactgttagctagtcactagatagaaagattattttagacaagttaagaagtttattatatcagcaagaactctagccccagagtgctctgcccaattgtacctatgtgactctaggtgggtcctttcacttggtgagccttggtttccacattcatgagagtggggtcagtgatacttaggttgcatggttaataagaactgggtatgtgtgtaaagtccctggagtgcagagtcaggcacagagagtgcccaataaatggtagccactgttatctttattgccattgccacagtgtgttttttggtgattgacagctttcactcttcaggaagttagtctgaaattcagttggcttaggagcactaattgttaataaattttgataagataggcttaagatattgtctgtttatttcccgaagtatatttttaaagaaaatattgtccagtagtgaaacg

SEQ ID NO: 1564 - DNA, 350 bp, Homo sapiens
caggggcacaatctcaactcactgcaacctgcgcctcctgagtttcaagtgattctcctgcctcatcctcccaagtatctgggactacagacatgcaccaccacacctggctaatgtttgtgtttttagtaaaggtggggttgcgccatgttggccaggctggtctcgaactcctgacctcatgtgatccacctgccttggccttccaaagttctgggatttcaagcatgagccactgtgcccggccctgctgggattacttttgtctgaaacccactggggaggaaggacaggccttggaaatgtcgcattaatagcaactgctccctctaatgggacgacacatccct

SEQ ID NO: 1565 - DNA, 501 bp, Homo sapiens
cttgaactttgagtttgcagagttttattggccacatgattaacttccttctccagctcctctttaatctctgaacatctgggggtgtggctaaaagttccaaccctctaaccatatgcttggtctgtctggcatggccagctcgtcctttcaaactatgtgagggcctaccttgagtcacccccaagtataaactcagatatagtccaaaggggcttcttatgaataacaaagacacttccattaatcaggaaattccaagcctctctaagctctgtaccaggaacaggagacaaagactagatttattcttcattatatgacagatacatttttatattttgcctctggttttagtaaagtttttgttgtgaagaacacaaatgccagatcaaatgaaggggctgtaattagcaaggctgcaagggattgtgagcagtaagggagatagggattttactggaaatccgccaaaggaactggtatgtagctatgcctctc

SEQ ID NO: 1566 - DNA, 638 bp, Homo sapiens
ccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccatttacattttttttctaaatataataaaaacttacctggcatcagccttataccaaaaaaaaaaaaa

SEQ ID NO: 1567 - DNA, 639 bp, Homo sapiens
accgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccatttacattttttttctaaatataataaaaacttacctggcatcagccttataccaaaaaaaaaaaaa

SEQ ID NO: 1568 - DNA, 620 bp, Homo sapiens
tcagctcctctgggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacac

SEQ ID NO: 1569 - DNA, 440 bp, Homo sapiens
tacggccgggatccccaaatttttctttgattcaattacaaatgaatcttgggacaccaaggcttataaactagttagttgatatatgcagtatagaatgtgtctagttctgtatttgttaaattattttcctatgatcttagcactaagtaatgttcctggaaatcatttcatttaagatgcctgccctaatctgaagtcagagctaaaatgatccaaatatgattttttttttaattgagacggactctcgctctttcccccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaaaaagggggcccatttcccc

SEQ ID NO: 1570 - DNA, 589 bp, Homo sapiens
tgactgaacatggatccctaaaatggctctacaactcgaaaaagttctgaacgtcaggtttagcttttgagtcatttcccccgctgtcaaggtggcaaatatatagcccaagaaggtggcttttgagtcatttcccgcaaggtcaaggtggtaaatgtgcagcctcagaacctcaaggataatgcgacagagctgcaaaatgaatggttgctccaaagatggaagcagcctttgtaaaactgccttagtgacagttaacttttcaacatcatacaatttttgttaacaccatgcaaaaacctatggtgttcagcagcatagcatactctataccgtaaccaaccctcttactgaagaaaagacatagtggataaattgcacttccaaaagttcttttgaatacctcaatgaactggcaacaacgtaagacctgttatagattgaattgtataccccccaaattcatacgttgaaatcttgattcccccaaatctcagaaagagtccttgtttggaaatacggtcattgcatatgtaattagtttagatgggatcattctggaataggataagcccccaatccaatatga

SEQ ID NO: 1571 - DNA, 341 bp, Homo sapiens
aatggggaaacctagtaggaattacccacgcagtattgacagtccctttgaggttaggatcactgaacctgagtgaagataacctgcctggtattgtgattttgctgtagcaaaagccctccggaagcaaatggttgaatttatgtggagtagggctttgccaggcaagcccaatgggaggagacagagggaaggagtagttatagtgatggatgacagacaagctagaaaaggctgggcgtggtggctcatgcctgtaatctcagcactttgggaggccaaggcgggcagatcatttgggcccaggaattcagaccagcctgggcaatatggcgaaaccc

SEQ ID NO: 1572 - DNA, 481 bp, Homo sapiens
ttttttttttttttttttttttttttatttttagtagagacggggttccatcacgctggccaggatggtctcaatctcccgacctcgtgatcagcctgccttggcctcccaaagtactgggattataggcgtgagccaccgcgtctggcctctaacgagatatttctaaaggttaggccttcagtcaagaattttaaagctggatcttagaggttatctaaactaacctctccatttcatagataaggaaagtgagtcccagaaaagcactggtttggacaagttcagaaagctaaacagtgactgtggatgtatgattctgtctcttaactcctaatccaaatgtcttctcactagataaggctgtgccttctacatttgaaggctcaaaccccatggatggatggagggaaggatgggtggagggatggatggatagatggatggatagatagtttactcattcattcagttatgcaag

SEQ ID NO: 1573 - DNA, 636 bp, Homo sapiens
ttttttttttttttttttttcgcagacaaagtaaaatttattgagacagacagaaatgcacctactcaggactacagttaagcatttactattaaccaaagagttgtgttcacattccagataagtctacgtggaaaagcattcagaatttactaggtttttgctacatcactatttcatctacaatagggacaacaaactgacactcaggatttgatgggctctcattacaatgctatacatttagcaggaacaaacatcagtgactttgagaaaaagttataaaaagaccaaaaccacccactgtagaatgggctcttggatgttactgtacagcgtggtcaaggtaacaagaagaaaaaaatgtgagtggcatcctgggatgagcagggggacagacctggacagacacgttgtcatttgctgctgtgggtaggaaaatgggcgtagaggaggagaaacagatacaaaatctccaactcagtattaaggtattctcatgcctagaatattggtagaaacaagaatacattcatatggcaaataactaaccatggtggaacaaaattctgggatttaagttggataccaaggaaattgtattaaaagagctgttcatggaataagaataaaact

SEQ ID NO: 1574 - DNA, 486 bp, Homo sapiens
tttttttttttttttttttttttcatattggttcttgagattagctagcgccacctcagctgtctgcttgttggctttcaacaccgccctcaatgtggcgatctgctcccgtttggtgctcagcagggactttaacttgaggatctcttccattaaggcttccttgtctttatcaatcatgggggctagctcccgagccgctgctctttgacgagacagttgcaaggaccggtccacagctttctgcagatgcttgatttggtcccggattatggcattaaggttgtagatattcattggctctttgcggatgtcacttgtatccaatactggagatgacggtggggcagtaataacaggagagattgtgggggtcttagttggacttggttctttgctggcctctgtgctttcttttgcaactggttcagatgaggtccttgtttctaccggggatgacacaccccgcctggctaatcgtgggga

SEQ ID NO: 1575 - DNA, 575 bp, Homo sapiens
taacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagccatggaataccctgggtgtgtgcaaatacactgtccaggatgagagccactcaaagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttct

SEQ ID NO: 1576 - DNA, 570 bp, Homo sapiens
cttttttttttttttttttttactggcatcctgtacatttacttttaaaaaaggataacaaaaatgaatattaacaaaaatccgggacaacaatattttcaagcaacaaaaactggggtggggaagcttattctgaaggtacatttaaaactgaaataacaacttaatgaaaattaagaattgcatagcgctgtgaatttagccttcagcaaaacaaaacagaagctatttggtattgatacaaatccatctatttgatagttagtcatccaatattatgtacatattttatatactgaatgtcattttaagtcctgttttccaaactccatttttctgttgctgggtttttgttttttgacaagttaaacactttctggcactttctatgacagaatttcttctgaacatacatgaactgacattctcccaaagcgtcccttgtgagtggacgcgcctttctgctacatatcgttcatttgttacaaaatgaaataatccacagtgcgatgtgtctgggtccaccgtgcacagcaacatccaggctaaaccaggctggaccaaaccttc

SEQ ID NO: 1577 - DNA, 371 bp, Homo sapiens
tttttttttttttttttttttttgggcatagaaagtgtcatttacagaaactacaatcatacaaagaatattttcttacacaccaaatgaaaaatctaaacattaataaagatttcttatattctaataattagtgggacctgacagaagcatcagtgaaatgtcatcaagactatgtgtgaaaattagacaagatgtgcacaattagcttcatctcagcaatatttagcaagagaccttttggtacaaccaattaggcaacatttctcaaacagtgccacgtagggttgtctctttttttgagaatgagtatccaggcctaagtattttaattctgaaggattgctgtctgcggcttcactttgcctatt

SEQ ID NO: 1578 - DNA, 591 bp, Homo sapiens
ttttttttttttttttttttttttttgcagtgtattttgatgtttttatttttaattggtatggagagagggagtgaagatagttttaagtggatacacttttcctttaatgaagacaagccgtaggtgggtgataaagagaaaaaagttaggctttagattcacacaatactgggtttaattcctaactttcttacttgctaggtgtgtgaccttgggaacgttatttaccaccaaatatgttgtcatatatgaaaagtaggagaatatatccttcaaagtttgctgtgcataagaaagatatatgtggcatttaattcagtgcctagcacatgcttattggcatcattaactgaaactcctgtgactactattcttaccattattattaatcatacttgctttcagcatgcagagagctcttatttattttacccctagctgattttctattacagcatatcagtctagggaagctgtgatgaaatcttcacttaaatctttgttcatttcagataagtggccctaatattgtttcttgtccatcaaaggacttcaaattagtagcttctgctatgcaataccccactg

SEQ ID NO: 1579 - DNA, 591 bp, Homo sapiens
ggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcaccatcagagcctttcctcaaaactggagtcccaaatgtcatcaggttttgtttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgctt

SEQ ID NO: 1580 - DNA, 197 bp, Homo sapiens
tgatttttttttattttttttttttttactgcttcctctttaattcgtctgagttttatgagccctaattcatagacctttgttgttgcatataaacttgaggataaacttgttgaattagatcaacgtaagcagttgaaattctgtgtggggtggtgatgaacggctctagcactttgtaaaaggtatttaaagcg

SEQ ID NO: 1581 - DNA, 538 bp, Homo sapiens
tggtagcgggtgcctgtagtcccagctactcgggaggctgacgcaggataatggcgtgaacccgggaggcggagcttgcagtgagccgagatcgcgccactgcactccagcctgggcgacagatcgagactccgtcccaaaaaaacatgagattgaaaaaaaaaaaccactgtgccccccccttgcttgatgattttctaattccactactaagtgacactcatctggcgtaacaacccgcaccccatcggtcaaacaaaagcggacaatgtacctttgacaagatatctggcaagagcaaatattcaatactggtggaatcttggacaaaaatctaactttcctgggaaagaggtaggggttagggtgggtgtcccatgttaagtggtcatttgggcaaaaactaaaaccaagtttctaaaatgaattttaaagtatggcaaatgactgatttagtcaaaaatttatcttctactctgaaaaaaatatgtttgtttaaaagacaaacgttgccacttttatactagagcacaatctt

SEQ ID NO: 1582 - DNA, 376 bp, Homo sapiens
ttttttttttttttttttttttttttcttttttttttttttttttttttttttttttttttctacacatgcttttttattagtatagataccttcacagacaatactgtaatttttagaggagttccacatcattacatcaacagggtgaatttctaacagaggcaaaactgagcaccatagtttacaagtaaaaagaccatgcttgaggacaacaaaagttcactaaggatgcacgattgatctgaaaagtttttaagcctggtcctcgccctcctcctcctaaaactccctttgttcgtcggccgtggggtcctggtactgctggtactcggacaccaggtcgttcatgttgctctcggcctcggggaactcca

SEQ ID NO: 1583 - DNA, 486 bp, Homo sapiens
tgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagcatcaaggacaccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaa

SEQ ID NO: 1584 - DNA, 530 bp, Homo sapiens
tgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtccccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcatcaagggtacccacaccggaatttccaggaagaaatagagtttcttaatgcaattttcccaaatggagcagcatattgtatgggacgtatgaattctgactgttggtacttatatactctggat

SEQ ID NO: 1585 - DNA, 437 bp, Homo sapiens
tttttttttttttttttttttttagggattattttttttgagacaagagtctcactctgtcgcccaggctggagtgcagtggcacaatctgcgctcactgcaacctctgcctcccgggttcaagtgattctcatgcctcggcctcctgagtagctggaattacaggcaaaaaccttttaaaatagccaggcgtggtaatgcacatctgtagtatcagctactcgggaggctaagatgggaggatcacttgagctcaggagtttgaaggtgcagcgagctatgatcgcaccactgcacaccagcctgggccacagagtgagatcctgtatattaaaaaaaaggaggggagtgttcaggatagtggctatttgccgacaagtatacaattaggtcaagattttaacaacaggcacgggtgccctggttgttaactataa

SEQ ID NO: 1586 - DNA, 445 bp, Homo sapiens
tttttttttttttttttttttttggcagaaggaagaggtttttttattcagccaggagcgttggcagactggtgtcttaagagccgagctcccggaaaaagaaattcctagcccttttaagggcttacaactctaaagggtctacgtgaaaaagtcataatagatcaagtaagcctgaggaacgtgactgggggctacaaacatcagctaacagaacaaaaagtttttacagtgctttctcatacagtgtctgggatttacagataacacaggtagttttggtcaggggttaatattattgttgttttaaccaccggggccaggtggtggcgccaaggtcctctagctatttattttacttctgttttttccaactttttgctttctcccttttttgctgtcttacaaactagggaaaagggggggttggggagaaactgggaag

SEQ ID NO: 1587 - DNA, 493 bp, Homo sapiens
agtttcttaatgcaattttcccaaatggagcagcatattgtatgagacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagtattttcttatgttagctttgaaacaaacttaagtcagacctcctatgatgacctgatcaggaaagttgtagaaatcttcaagccaggaaaatttgtgaccaccttgtttgttaatcagagttctaaatgtcgcacagtgcttgcttcgcc

SEQ ID NO: 1588 - DNA, 637 bp, Homo sapiens
tacggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctggggaactgaggctggccctcattcggggtcgggaaccgagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggac

SEQ ID NO: 1589 - DNA, 463 bp, Homo sapiens
atcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctgg

SEQ ID NO: 1590 - DNA, 595 bp, Homo sapiens
gtccttaagttccttgcaacaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaag

SEQ ID NO: 1591 - DNA, 527 bp, Homo sapiens
ggaagaggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctggatggaagaagtcagctggtgggtctggaggagcacgcggaggaggacagaatgggcaggaagaaaagtggtgtgagaaagcagtgaaaagtctggtgaggaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaac

SEQ ID NO: 1592 - DNA, 495 bp, Homo sapiens
tatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctg

SEQ ID NO: 1593 - DNA, 573 bp, Homo sapiens
aggcattgaggcagccagcgcaggggcttctgctgagggggcaggcggagcttgaggaaaccgcagataagtttttttctctttgaaagacagagattaatacaactacttaaaaaatatagtcaataggttactaagatattgcttagcgttaagtttttaacgtaattttaatagcttaagattttaagagaaaatatgaggacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatagaaagattaattggga

SEQ ID NO: 1594 - DNA, 469 bp, Homo sapiens
tggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatctcctgcaactggaagaagcaatttggcgcggagtgcaaataccagttccaggcctggggagaatgtgacctgaacacagccctgaagaccagaactggaagtctgaagcgagccctgcacaatgccgaatgcc

SEQ ID NO: 1595 - DNA, 366 bp, Homo sapiens
gcagtgagctaagatcccgccattgcactccagcctgggctacagagcaagagtctatcaataaatgaatgaatgaatgaatgaatgaatgaatgaatgaatgaatgaatgtggttgtgggcaactccaagaacacatcttggggtgctagcctactggtgacagtgttcaggaaggccgttcctgaggaagtgacattgaagcagagagcttgaaggaggtgtaaaatcctttttatagattttaaactaggtaaagactagggggcagtgtttgaggcacagggaagcatctgagcaagagcaagggacctaagagaaggtaaagaagaggagggtgatgaagatgaagatgcaggaggatagg

SEQ ID NO: 1596 - DNA, 467 bp, Homo sapiens
gaagcctgttcacccgtctgtgtcatgtggccatcttgagtctactctgtcgctcttgtgccctagcaccccgagaaccgtcagtttgagccagatggtgagtaataacctgtaacactttggttgctggttaattctggattgtgaatctccatgtatctttgggacctgtcagccgtggcagtctcccttactagccatggaagagcatatgcttgtttattggcaaagctgtcaccatttaattggtatcagattctgacttgcacaagtaacattcactgttaaaaacctaaagggcgccgggttattgggcaaaatttctaaaccgttgttcaatgtttctaggaagctgagctgaacacattacgatggatgatggaaacataagggacattccttttttgatatttctgagttaatctgaaacgccttaccggcaggacgttggaaagctaaagttggct

SEQ ID NO: 1597 - DNA, 709 bp, Homo sapiens
atctgacaccgtcaccagtaggagacctcagtgttttgggtctaggtgagtgcaggcccctctccccacacctcgccccacagagccctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacaccttt

SEQ ID NO: 1598 - DNA, 555 bp, Homo sapiens
aaaggcagctcactgaagcggctccctgtttttggaatggagcctcgcatcctatacaaccctttacaaggccagaaatgtattattcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggttt

SEQ ID NO: 1599 - DNA, 452 bp, Homo sapiens
agaagaagaaacaaacactgatctctttctgccacccctgaccctttggaactcctctgaccctttaggacaagcctacctaatatctgctagagaaaagaccaacaacggcctcaaaggatctcttaccatgaaggtctcagctaattcttggctaagatgtgggttccacattaggttctgaatatggggggaagggtcaatttgctcattctgtgtgtggttaaagtcaggatgcccaggggccagagcagggggctgctgctttgggaacaatggctgagcatataaccataggtatgggaacaaaaaacatcaaagtcactgtatcaattgccatgaagacttgagggacctgaatctaccgattcatcttaaggcagcaggaccagtttgagtggcaacaatgcagcagcagaatcaatggaaacaacagaatgattgcaatgtcc

SEQ ID NO: 1600 - DNA, 491 bp, Homo sapiens
gatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattatt

SEQ ID NO: 1601 - DNA, 444 bp, Homo sapiens
gtgggaatcattacaaaacattatgaatatagttaaagcaactgaactgtacacttaaaatagttaatgtgatacattttatgttacatgtatttctgcccactagaaaaaataaaaatatataaacacacagcaaatgatgaccaggcctttgaagaaagcttataaaacaaaattaagaagccaaggctgggagtggtggctaacgcctgtaatcctagcactttgggtggctgagatgggcggatcacgaggtaaagacatcgagaccatcctggccaacatggtgaaatgtatgtttagtctctactaaaaatacaaaatttagctgggtgtggtggcatgtgcctgtaatcccagctactgaacccgggaggtggagattgcagtgagctgagatcgcgccacagcactccagcctggctacagagcgagactctgtct

SEQ ID NO: 1602 - DNA, 593 bp, Homo sapiens
tctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagatttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaacgtagggttataataatgttaacatggacatgatcttctttataattctactttgagtgcagtctccatgtttgatgtatctgagcaggttgctccacaggtagctctaggagggctggcaactt

SEQ ID NO: 1603 - DNA, 552 bp, Homo sapiens
attgatttcttttttctcacagcaacaagtgcttactctagaggttagtgggccctgatatgtcatcagtcagatgcctgcctagccaaagctggactaagattattctgcacatttgttgatcttgatatagacttatatccctgtagggactgctaatggctccggcttctggagtaaggtactggagaccactcatccctgtgtctgcttgattggttcagctgttgaattgcccttttatttggaagcagtgttgaagttgtctagggttcaaatggctgctttgtacacctgtcatcagtataaggcagatgtttattttatcaagctattttatctctacatttaactaaaaacaaaagttcccaaagatctgccttcacttcagaaattttttttggattaaaaaaattaagcctgaaccttaaataaagtgagttggttattcattccaaggattaagtcccaatctacctctcagcacaatgcagaagctcaccactgtattgctgccattaactcatgccagaaccctttgccaataactgg

SEQ ID NO: 1604 - DNA, 567 bp, Homo sapiens
  misc_feature 519: n = A,T,C or G
gcgagtttatgtttgactttgatggtgatgagattttccatgtggatatggcaaagaaggagacggtctggcggcttgaagaatttggacgatttgccagcttagatgctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacngtggtgtgtgccctgggcctgactgtgggtctggtgggcatcattatt

SEQ ID NO: 1605 - DNA, 556 bp, Homo sapiens
actgttaacagtagaggtatgtccagaaacctagtttagtattttacaaattgctcttcctcactatatttgctctgtagtcctgaaacttgcatttttttctctgtaaaaactctggactcttcacagttgctctttgggttggaaagtccttttcaaagtaagatatctacaatctcaaccatacatacacaccctcccaatctcccacacccaggacagtgatgggcagaagttgggcagaatttgggcaggaaggccatctcgccccacctgccgtgctgcccagctgaatgggcggcaggactccatgtggcatttaggattctcaaagctgcaggaaactgaatggaactcttgtaaaacacgccctcgccagctttctcctacttcttctagtctctgcttgtcaagagctaggtggactttttgccctggactgagattccgaggtgggaggagaagttggattaagagacttgatgccttcaaaacgttcagggtatgacaagggcctcactcccttagaaagaaatgggtgatagaagaggaaagc

SEQ ID NO: 1606 - DNA, 496 bp, Homo sapiens
caggtccggcacatgtttccgcggagcggacccagcaatgacggtaaggggctcccttcccccgacggtggtagtcggagcccgggcttattagcaaacgtgagaggagcagagtatttttacccaagtggcactggggtaggagggctggaatttagccctcaagagcaaggaagcctagggaaagggcagccggctctttaggactgctgtaagacgagtgaacctggggccacttctgaaaacacagattgactgtagaggggacagtgcccgaagtgtgatcacaggtttcagaaagactggggcgcacagcttctacccagttatccactgaaaatccggtaaagccattcctaactatgccattcagttcaacaaataacgactgaatgtattcttgagttctggcgccgcgttacgtgctctggagtggcggaataaagccggcctcttaacttccggggcatgtagttttcaattattgcgacaaggg

SEQ ID NO: 1607 - DNA, 565 bp, Homo sapiens
gaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatatagatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatccctgacagttagagccgatatcactggaagatattcaaatcgtctctatgcttacgaacctgcagatacagctctgttgcttgacaacatgaagaaagctctcaagttgctgaagactgaattgtaaagaaaaaaaacctccaagcccttctgtctgtcaggccttgag

SEQ ID NO: 1608 - DNA, 500 bp, Homo sapiens
acatttacattcataatctgtttaatcttctgttgaatgcccttgtgcactctctttgccctgttttagttccctacttgctgtagattataagtgcccttaatatctccagtatctccacagagaattttgtcttcaagccttggcatcctgttttccactgtgccttcaacctgagacttcagtgatttcacaaatgctctgaacaatggagttttgaaatggttaccatttgtattagtttcctgtggctgctataacaaactaccacaagcctggtgacttaaaccatcagaaatctattctctcacagttctggaagccaaaagtccaaaatcggtatcattgggcgagaagcaagatgtcagcagggctgcattccttctggatgctctaggggagaatccttttctttgccttcctcagcttctgctgaccactaccgttttttggcttgtggccacatcactgcaatctcagcttctctggtcacattaagt

SEQ ID NO: 1609 - DNA, 589 bp, Homo sapiens
  misc_feature 509: n = A,T,C or G
acccattgcctggtttcgcaggagactgtccgccttcagttctccagcagctcggggatcatggcccactgaacccccaagcgctttcacccgaacccaaggaggacgaccaggaaagacgggaactcgcgtagacacgcccggaagcccttgtcatgtaaatagctgtcggggactggtgtattgtcgccgccccagccggcgggacctggggcgaatccacacccattgtctgctgcccaaggggcctccggctggggggcgcggctgcggagttcaaaaggggtatgagcaggaggggtgtacttttagttcattaagttttaattacaggagtgctacaagaacacattcttcaggtttaaaaagatattaaaatattacataagagacctcccctccctggcccacctccagcctcttaaaaatttagtgtgtcgccttttagacactttctcaaagcttcacttatttaacaggcacttaaggagcacctacctgtgccaganactctccaaatattaactcaacctgacaccgactcagtgtggccgaatattactctccccattttacagagcgggcagct

SEQ ID NO: 1610 - DNA, 486 bp, Homo sapiens
attcctgaagctgacagcattcgggccgagatgtctcgctccgtggccttagctgtgctcgcgctactctctctttctggcctggaggctatccagtgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttatattgatatgcttatacacttaca

SEQ ID NO: 1611 - DNA, 552 bp, Homo sapiens
cagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggtaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctct

SEQ ID NO: 1612 - DNA, 415 bp, Homo sapiens
tggtggcttgcacctgtaatcccagcattttgggaggctgaggcgggcagatcacctgaggtcaggagttctagaccagcctggtcaacatggtgaaatcccatctccaataaaaatacaaaaattagctgggtgtggtggcacatacctgtagtcccagctactccagaggctgaggcaggagaatcgcttgaacccaggaggcagaggttacagtgagcagagatcgtgccactgcactccagcctgggcaacagagcgactccgtctccaaaaaaaaaaaaaaaacccaaaaaccgggttggggggtaacccaaagtcatttccttttaaggtttttaaaaggaaaaaaaaaaaactgccccaaggaaggagtcttaaagggttttttttaaaaaaaaaattttttaaaaat

SEQ ID NO: 1613 - DNA, 501 bp, Homo sapiens
ggtgtgtgagagccaggcgtccctctgcctgcccactcagtggcaacacccgggagctgttttgtcctttgtggagcctcagcagttccctctttcagaactcactgccaagagccctgaacaggagccaccatgcagtgtttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgccaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtg

SEQ ID NO: 1614 - DNA, 296 bp, Homo sapiens
  misc_feature 64, 187, 195: n = A,T,C or G
aggttcctcatctgctcgcgaggatgccttttctcttctgccttgcgaaataacagcagcctanctgttgcccgtgaccagtgagaaaggcagcgtcacgggctgattaggtttcacccaaagggtgccggcgccgaattggtttctaacgagaacttttaaaatgatccgttccaaaaaagggtangagccgcnagaccctccaactgcccagagaaaacaagtctcgtctggcaaaattctcggcccacgcggtccgcggccaaggggcaaaggtcctcgccccacgttgccga

SEQ ID NO: 1615 - DNA, 115 bp, Homo sapiens
ccctgttggcagtgggcatctgggtgtcaatcgatggggcatcctttctgaagatcttcgggccactgtcgtccagtgccatgcagtttgtcaacgtgggctacttcctcatcgc

SEQ ID NO: 1616 - DNA, 189 bp, Homo sapiens
gcagcaccggaggcccaggtctccgtgcagcccaacttccagcaggacaagttcctggggcgctggttcagcgcggacctcgcctccaactcgagctggctccgggagaaaaaggcggcgttgtccatgtgcaagtctgtggtggcccctgccacggatggtggcctcaacctgacctccaccttcctc

SEQ ID NO: 1617 - DNA, 103 bp, Homo sapiens
tatgacaagcaaaggaacatacttgcctggagatagcctttgcgatatttaaatgtccgtggatacagaaatctctgcaggcaagttgctccagagcatattg

SEQ ID NO: 1618 - DNA, 176 bp, Homo sapiens
aacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggac

SEQ ID NO: 1619 - DNA, 574 bp, Homo sapiens
  misc_feature 58, 278: n = A,T,C or G
ttggaaagccaggacacaacgctgctgcctgctttgtgcagggtcctccggggctcanccctgagttggcatcacctgcgcagggccctctggggctcagccctgagctagtgtcacctgcacagggccctctggggctcagccctgagctggcgtcacctgtgcagggccctctggggctcagccctgagctggcctcacctgggttccccaccccgggctctcctgccctgccctcctgcccgccctccctcctgcctgcgcagctccttccctangcacctctgtgctgcgtcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccc

SEQ ID NO: 1620 - DNA, 484 bp, Homo sapiens
  misc_feature 331: n = A,T,C or G
tcggcacgagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctanggcttcctggggttcccttcttgggcctgcctcttaaaggcctgagctagctggagaagagggagggtccataagcccatgactaaaaactaccccagcccaggctctcaccatctccagtcaccagcatctccctctcctcccaatctccat

SEQ ID NO: 1621 - DNA, 638 bp, Homo sapiens
  misc_feature 631: n = A,T,C or G
tttttttcatgcttccacacctttcttgctgaaggacaaagtacataaaatgccggtgtttggcttccagatctgaaggaagctgtttagtactctggcaggatcacatcttgctgtggaacttcaaaacccacagcagagcttccttgcccttctctgggagctgctacctcctccacagtcttcagcttctcctctgctaggccctcctctagttccaggtcagccacctttatcccatcctccactgccttgggcaccattttgggggcctcttcagcatttatatctgcacctttaactttctctaaggcttgcaccttcatcagctcagcctgtgcccccttaactgcggcttgggccccatcgccttgaattttctctccttctggaatagctttcatgtcctcgttgccatcttggattggagaagggtctcggctagccttgtggctctcctggatgctgccatggctgctgctggcacttcccaggcgggaagaggccaccacagccttcaccgctgccttaagcttacgccgggcattgaattcttggagcttcttttgagcggtattcatgtgtaccaaattggctgctttacctgtgacccacggatgctggagagctngaaatga

SEQ ID NO: 1622 - DNA, 709 bp, Homo sapiens
tttttttgttaagtaacaacagatcttcctgctttactaaatctattcttcccccaagccctcgagaagccctggcaggaaccaggctggctactgagctctgggcgggggtaggggggtctggcctgctgcgggccaagttggggcaggacatacagcccattccatggggaggatgaggcccctgggggtcagtgaggcacggctctgcctcaaggccaccccctcctaaggacacagccatagtcgttgctgcccatcatctgcagggcactgacgcagggctccccgtcctcctcgtcaggctcctcctcgtcagcctcctcgtcggcgtggtatgacacgggcccgctctccaccagcaccgcctggggcctggcaggctcagctccgagggtgggagagcttgggagcaaagcctctcccgtggccaccttctttgctggctgcgtagacaccagaggcctcaaccttttccccacactggtcacagggtcagccccacttctgctggccggcgtcctccttcgtgacagcttcctggcactggcgctatgctcgggctgtgcatcctccctgtgcggactgccccccgcggcgctgctgaggccccggagcacgctataattgatcttgctggagatctttctctgctcccagcatctctcgatggcctccctggcgtactggcctgaattggctcccgtcg

SEQ ID NO: 1623 - DNA, 648 bp, Homo sapiens
ttcggcacgagggagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagcctt

SEQ ID NO: 1624 - DNA, 554 bp, Homo sapiens
aaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatc

SEQ ID NO: 1625 - DNA, 452 bp, Homo sapiens
tcggcacgaggcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatg

SEQ ID NO: 1626 - DNA, 548 bp, Homo sapiens
tttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccag

SEQ ID NO: 1627 - DNA, 606 bp, Homo sapiens
  misc_feature 197, 531: n = A,T,C or G
ttcggcacgagggcgctgacttctatggaaaccagatcaagcccaaaatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccanaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctangtgcccctgatgatgggatgctctttaaataataaagatggttgtgattaaaaaaaaaaaaaaaaaaaaaatttt

SEQ ID NO: 1628 - DNA, 484 bp, Homo sapiens
tttttttcagagagaaagtgctttatcagccgggctcagccccgcacacggactcgccaggagtaggtggtcagcacgcgctgctggcggcgcaccacgcaggtgtaggtgccctcattgacggcgttggcgatgatgctcaggtgcgcctcgcccagggccaggtagccggggtaggagaactccaggggctcctggtccttgtaccagtacactttccctttcttgtggaggatcttctggccgcagcggaaggtcacgttcctgccctcgggcaccagcctggttttggtcctggggggcggtggggtggtggccaccgtggggaaggggaattcgtagcagaagtcgcagctgctggggcagagcctcttcatgagccgccggcgagcgtcgcagaagcccctccgcgcccaggacgcgcacacgaacagcctgtcgaggcatccgtagagccggtgcagcccccacagctcgtcctggg

SEQ ID NO: 1629 - DNA, 620 bp, Homo sapiens
ttcggcacgaggccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccat

SEQ ID NO: 1630 - DNA, 462 bp, Homo sapiens
  misc_feature 422, 439: n = A,T,C or G
tttttttacatgtctattttttattcaatatattaaatatattaatcagaaaagtcacatactataaatccaggaaaatacacaaatataaatgtcagaatctgtcatttgtcttcttcctagagtgacagtttatgtacatgtggaaggagggtaggaagagagagccagcaggaggctggaaaggctgcccaggaaggcggggccatcccttcctcccagccccgctcccacctcaagctctttcttcctgtatttacagcagcactgggcttatttacagcacggcgctatgtgttaaaaacggtttatcttacaaaaaacataaaggccggggcaaggctgggggggataagacaaatcgtggggtcaccccatgaaggcatccccctccccaagggcttgagctccctgcaaacctnctggagcaggtgagaangtggagtcattctgcagctcaag

SEQ ID NO: 1631 - DNA, 631 bp, Homo sapiens
ttcggcacgaggtgcttctaggtttcgtatattttcccaatttagaccttcaaaaaacgcatgctttttgaaatcctctattccattctgccccagccggcgttctctactgcagatcagtctctggatgaggtccttcgcttcttcagatacatccgtgacatgggatgggaactggaatcgctcttcatggttcatgatcttcccataggtctccacgagtgactccgcataaaacggcgtttctccatagagcatctcatacatgcagacacccagagaccaccagtcacactcaggcccgtatttgcccatgccgtcctccatcgcctgcaggatctccggcgagatgtagtcaggtgtgcccacggccacggaggactgcacagtgccatcatcattcatcttcaaacatgatccaaagtcagccaggcggatatgaccattcacgtccaaaaggacattgtcaggtttaatgtctctgtgcacgtaatgaagctgatggatggagtcaatggccagcaccatttcaccaatgtagaacctcgccatatcttccggaagcttgtcttcaaatttgctgagcagggtcagtaaatcaccacccacatagtaatccatgactaagtac

SEQ ID NO: 1632 - DNA, 723 bp, Homo sapiens
  misc_feature 4, 81, 113, 157, 253, 259, 464, 477, 490, 549, 569, 610,623, 630, 638, 650, 663, 701, 706, 714: n = A,T,C or G
gcgnccgcggcgggcgcccctgccagtgagcccctgtccgaagtgagccacggcattgactcggggctgcccgggggaggngcactgaggagggagttgcgcgcgcgaggcangggcgatggggccaagaagaaccggggcgatacgcggcaggtgnacagctgggacccgccgcggtcgggctgccccctcccctcgccccgaccgctcccctgctggtgagggcctgcggaggcggcggcggcggcgcctntggtgncagtggtggcggcggaagcttccccgggatcgtgtccggagctcgaggagagggtggtgcccggcgagctatgcacgggggcggcggcgtctcctcctgttccgcctcctcagtctcctcggtctcgcagaatccgccggcggccgcgccagggacatggagctcgagaaatcgtggccaactcgtgcttctgaaacgcgtcaangcagaatatgaanttccgatgatgangaccgaaatgattgtggactgtcaatttaagatagattcttcaatgataagtttgcaancccttttacaagaaatactnccagatgttgttacaagaatgtagatttggacttaaaggangagaacccttccnaaaaaanccttttanggaatttccttnaaggggaaatttnggccttaaaaggttggaatttcccaaaattccttaaanggggnccattttnaaaatccca

SEQ ID NO: 1633 - DNA, 423 bp, Homo sapiens
  misc_feature 212, 330, 380: n = A,T,C or G
tcggcacgaggcgaggaaacaggcttcggctcaggcacccgggccctggagcaagccctggagaagacgaaagccaacctcatccaggcagtgacacgacgattctccaccgagtatgagctgcagcagtggttcacagaaaacagcaaatagtccccagcccttgaagtcacccggcccccatgcaaggtgcccacatgtgtccatcccancggctggtgcagggcctccattcctggagcccgaggcaccagtgtcctcccctcaaggacaaagtctccagcccacgttctctctgcctgtgagccagtctagttcctgatgacccangctgcctgagcacctcccagcccctgcccctcatgccaaccccgccctangcctggcatggcacctgtcgcccagtgccctggggctgatctc

SEQ ID NO: 1634 - DNA, 573 bp, Homo sapiens
  misc_feature 345, 502: n = A,T,C or G
tgtctccctcctccccgaggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccctancgcctgcagtttggagcactggcgccagccagagctggagcggcgcttctcccgggtccaagaggtcgtgcaggtgctaagggctctccgagccacgtaccagctcaccaaagcccggccccgagtgctgctgcagagctcaaagcctggggaccanggcctcttcgaggccttcttggagcccctgggcaccctgggctactgtggggctgtgggcctgttaccccc

SEQ ID NO: 1635 - DNA, 448 bp, Homo sapiens
  misc_feature 172: n = A,T,C or G
atggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcancatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgacccc

SEQ ID NO: 1636 - DNA, 578 bp, Homo sapiens
tggcacgagggggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcacc

SEQ ID NO: 1637 - DNA, 639 bp, Homo sapiens
attcggcacgaggtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcacgaaggagtctcatgctgcccgcaagcatcaacgcaagctgctggccgccatcaacgcgtgagggccgctttgtatgcacacgtgtccatgtgcacccatgtccaagtcacctctctgcacggctgtgtgtgtgcatgtccatgcctgtccaggttccgccaggtgcggctgatacaccggaagctccgggaacaagtgaactccatggtggacatct

SEQ ID NO: 1638 - DNA, 897 bp, Homo sapiens
  misc_feature 356, 574: n = A,T,C or G
cgcctttgcccgaagcccggggacgaaccgacggaccgaccgcctggcgcacggacgcgggcctcgctttgtgttcggggctagcgtcggcgaggcttgagcttgcagcgcgcggcttccctgctttctcgcggccaccccggctccggcggcctcggcgcgcgaggggctggaggtgcgggaccgctctccgccggtcggtccgcgtgcggctgagcccaggccgccagcgccgcggccgcgtgcggtgtccctgagctcctgctccccgccgggctgctccgagcaacggtgcttcggagctccagactcgggctggcgggggggggatgattgtggggggggaggagtgtcgngaagcactacaagggtcctgaagtcagttgttgcatcaaatacttcatatttggcttcaatgtcatatggtggttgttgggaataacatttctgtgaattggactgtgggcatggaatgaaaggggagttctgtccaacatctcttccatcaccgatctcggcggcttttacgcagtttggctcttctgtgtggtgggaggagtgatgtgcattgtgngatgtgcatggtgcgatggagcgctactggaaacacattctgctgtagttttgtcgatgtcgtgggagatttctcgtggacgaagtgcgagtcggcgttggtgtaagacggatagagcagtgggtcggtgggaagattggcgtggggtgggtggtttattgtagttcttggtttggtgtggtgtggggtgtgtgggtggtgtgtggtgtgggtgggttgtgggtgtgggtgtgttggagaggggtggggtgtattttttatttgtttttggggggggtggtgggcggggtggggcgctgaacagggttcgtgagcgagctgga

SEQ ID NO: 1639 - DNA, 501 bp, Homo sapiens
gtctctttaaaatcatttttaaaaagttacaaaacaatatcattcatcatatattcttattttcctttttttaaaaaattaaagtaataaaaaagtcactttataaaataatataaaagggcttgatgggtggggccggtgggtgctgtctgagctggtggactgaggaatccagtgcttctcttctggctaccccctcgttgtcaggaaggacccccaggccacagatggggatgacagcaggtcccttgtctctggctgggctgtgggagaggggcagggaaagccggggcaggagggcagtgggcagacccagacaggggggacggctggggccctgtcccgaagagacgggagggcctgctggtggggggtgaggtggcactggggcagcgggtgtctgggcccctcagtgccggctcctcctccagacagtctgcctagcttccgttgctcagcatccccagcagctcactgggctccagtccctgcggctgggcc

SEQ ID NO: 1640 - DNA, 576 bp, Homo sapiens
cggcacgaggcgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaacctt

SEQ ID NO: 1641 - DNA, 630 bp, Homo sapiens
attcggcacgagggaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccattgccaggagatggccccaacaagcaccccgcttttgcagcagaggagctgagttggcagaccgggcccccctgaaccgcaccccatcccaccagccccggccttgctttgtctggcctcacgtgtctcaaattttctaagaaccaaaaaaaaaaagggaaaaaaa

SEQ ID NO: 1642 - DNA, 602 bp, Homo sapiens
  misc_feature 173, 536: n = A,T,C or G
ttcggcacgagggagatggtgatggcccagaaggcagcccgcaggccaggatcaggtctgctgcggccaggttccccaggtagatctctgccaccgtgcagctgctcttgtgcaggcagaagacgctgaggacaaagatgttctctagggtggccagcacgaacagcacccanaggaaggggggctggatggtgttgagccagcccagccactccacttgggggcatttgctctgggcaaaggtcccgttaagagtgggcccttgcaaggtgacattgagcatgtcggcgctgaaagaggccgtggtgggcacggagtcctcacaaacagacagaaacattgatatcttccagggagagaacatttggactcagagtgggatgtgagtgaggccacacctgggcttctccggagcaagcggcatgggcactcgacctgcttctgggtcggggtttcgtacgtagcagaacagctccctcgctgcgatctattgaaagtcagccctcgacacaagggtttgtctacgaatggtttancgccaggttccccacgaacgtgcggtgcgtgacgggcgaaggggcggccgcaagcttattcccttt

SEQ ID NO: 1643 - DNA, 556 bp, Homo sapiens
  misc_feature 492: n = A,T,C or G
ttcggcacgaggatcctcagtgcaaactcgctggcacagagatgttcaatgatggcctcagatttcaactcgttgtcacagggaggacacaccgttgtgccttggggcttggaggcttcggtggcattgggcggcgtcatggcgatgcagacgtccccctcggggaacttgtcacacttaagcatctcgggccagtagaagccgaagaactgcatgaccggctcgcacgaatcgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtanaagcgcccgctctggtacgggccgatgtccgactggaagctcacgtagtcgtactcgctggccg

SEQ ID NO: 1644 - DNA, 462 bp, Homo sapiens
tttttttttacccaagagagcctttattcagccacactgacggctctgagcagagcacctcctggccccactggtacccaggaaacatgcccaggttaaagctgccccccagcgtaggggctgaggtatggtcagtgggctgaggcttgtagactgtcggggcagtctattgaaccagaaagacagttccttgccctggatggcctcagatgtctttttccatccagaatatggggcgccccctcacattttgatattgtgtctccagcaggctttttgaagggggccctgatggaactgggggtgagatggtcaggcactcaggtaggggagggggtggtggcaatggaggtcccttggcacacttggggcagcttgggcagtcaggtttggggccttcctgggtggccggggagagggggctgtggggaaggcattaagcagggtggcaggcagcagtct

SEQ ID NO: 1645 - DNA, 172 bp, Homo sapiens
gagaagacgacagaagggaagggacccacaggaagttacagtggtgcccacggatgtgtcagcctccagccacggggacgcgggattcaagaatgaagttgatacaggctcagtcaagaccttaaataaaaatttgtacaaagaaaaaaaaaaaaaaaaaaagtcgtatcga

SEQ ID NO: 1646 - DNA, 158 bp, Homo sapiens
  misc_feature 134: n = A,T,C or G
atacggctgcgagaagacgacagaaggggattagaggtgcattctttaatgcaccctgtgcacaggtcttttgcgagatacgcatgtgctgctgtcgcaacagatgattcaggatctgtctgcactgtaggcanaaaaaaaaaaaaaaaaaaaagtcg

SEQ ID NO: 1647 - DNA, 140 bp, Homo sapiens; identical to SEQ ID NO: 979

SEQ ID NO: 1648 - DNA, 291 bp, Homo sapiens
gataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcg

SEQ ID NO: 1649 - DNA, 505 bp, Homo sapiens
ggtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacagggtatgcagacacaactacgagctggacgaggccgtgaccctgcagcgccgagtccagcctaaggtgaacgtttccccctccaagaaggggcccctgcagcaccacaacctgcttgtctgccacgtgacagatttctac

SEQ ID NO: 1650 - DNA, 575 bp, Homo sapiens
gatcccgctctggtgccgctgcagccggcagagatggttgggctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttaactgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatca

SEQ ID NO: 1651 - DNA, 362 bp, Homo sapiens
ggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagagcgagttccagggagagctggagaagcagcgggagcagcttgacaaaatccagtccagccacaacttccagctggggagcgtcaacaagctgtaccag

SEQ ID NO: 1652 - DNA, 543 bp, Homo sapiens
gacagaggggagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaat

SEQ ID NO: 1653 - DNA, 520 bp, Homo sapiens
ctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgac

SEQ ID NO: 1654 - DNA, 621 bp, Homo sapiens
tcggcacgagggcagcttcactccatgtcatatatggcagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactgtagtaatttaactgtttatgttacccacgttgggatccagttggtcttggtttgcttctctctgtaccacgtgcaca

SEQ ID NO: 1655 - DNA, 649 bp, Homo sapiens
accgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctgcgaacattctttgggcctcctggactacaggagatgctgtcacttaataatcaacctgggggttcgaaatcagtgagacctggattcaaattctgccttgaaatattgtgactctgggaaaatgacacacctggtttgtctctgttgtat

SEQ ID NO: 1656 - DNA, 579 bp, Homo sapiens
tcggcacgaggtcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagac

SEQ ID NO: 1657 - DNA, 366 bp, Homo sapiens
ttttacacataaaaaacctacagtttttattattagattccatcaatcctaccagaaaggggatcccggactccatggctcatggttcacagggacccaagcaagcatacggtcaacagctcaagcagcagcactgggtgggatctggaggtgcctgagtgggattctggggcacctgggccgggcccaagacatgcctgaagtgagattcagccagggttctctgaatccagtctgtgtagcttagcacctgggtgtagacaccaggccggaaagcgggggcacagcgaatccccagctcacaatgccggcctggatccacgtatcattgatggggcagaccagcggccccccggagtcaccctc

SEQ ID NO: 1658 - DNA, 551 bp, Homo sapiens
tagtggatcccccgggctgcaggaattcggcacgaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgaaaatgagctggccctgcgccagggcgttgaggctgacatcaacggcttgcgccgagtcctggatgagctgaccctgg

SEQ ID NO: 1659 - DNA, 660 bp, Homo sapiens
actgtattttctgggtttattcccccttgttccaagctctaagcctcagcttactccacctccatagcctgcacagtttcctccactagctccagggttagtggcttcactgtctgggtcaggacagctgtggttccaggcacaaagtggtagcggccagacctcttcacgggctctgtgggtgagctcagtgtccgcagcagcttggcgccagtctttgtgatcacacatgcgtccacattgcccccggagcccaggtcacccaagatcccggcggtgacggcttccaccagcagcccctgagcagcctccagcgtcatgttcggctggaaccggtcttctagcaccgccagggccgcgtcctgaccagagcccagggctgtgaagggcagacggctgtaggagccatggggatgcacaccgtagagctgcggtccagtcaggtctacgccgcccacgatcagcgatgcacccacgtggccctggtacctgaagagcgtctggcgcaggatggcagtgaccgtggccacgcggggctcgcggccggtagataacgcgtgtagctccatcttggacgccaccatccgtgtggtcatctcggcgtccggggtactccagcccacaagagtaaattttgggggcgatgaagtggattttctc

SEQ ID NO: 1660 - DNA, 480 bp, Homo sapiens
  misc_feature 386: n = A,T,C or G
ccgagccaacaacctttattgtcaccaggcaaggaagcagggggaagggactgaagcagggggctgaggctggagaggccggaaactttggggcaaagggggcggctgccccctccccccggggtggccgcccggggtagctaagtccccaccggggggtctgggggacctccccccgggaggagatgaccttgccatcctggacctcttccaaaatggtacgcccctgagggggggtcaccggttctttcttgtaatgagtcaggggggcatcccccccccccagcaggcggcggtagggggtaatctcctgctccagccgcgtcctcacatccagcaggatttggaatatctggttctgcagctccatcccgaagcgaaggggncccagttgctcccccactctgccaatcagcccctggattctgggaaacctccacgcaatagggttttctcttgtccccgccaggttgaccctcc

SEQ ID NO: 1661 - DNA, 616 bp, Homo sapiens
  misc_feature 310, 360, 405: n = A,T,C or G
acaacgaggaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccangctgcctgagcacctcccagcccctgcccctcatgccaaccccgccctangcctggcatggcacctgtcgcccagtgccctggggctgatctcanggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgaaaaaaaaaaaaaaaaaaaaaaaaaatttt

SEQ ID NO: 1662 - DNA, 494 bp, Homo sapiens
ttcggcacgaggcaccagccccagtccccagctgtgccgcttgctgggcacagagcctctggtaactgccccctgatacacacagtgcccggggatagaacccgtgtgcgtggacctgggtgactgggaggccaccgagcgggcgctgggcagcgtgggccccgtggacctgctggtgaacaacgccgctgtcgccctgctgcagcccttcctggtagtcaccaaggaggcctttgacagatcctttgaggtgaacctgcgtgcggtcatccaggtgtcgcaagtgacctgccctgtgggctggacgggaattctcgtgagtgatgccagctctgcctcacggtctcgctgcgattccagattgtggccaggggcttaatagcccggggagtcccaagggccatcgtgaatgtctccagccagtgctcccagcgggcagtaactaaccataacgtctactgtgagtgccccagctgtgccctcagccccacccc

SEQ ID NO: 1663 - DNA, 428 bp, Homo sapiens
  misc_feature 298, 351, 413: n = A,T,C or G
caccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagccctgtgacctcacagccccaaccagaaggtgccaatgaagcagtccccaccccctgtggtggacccagatgcacctccgtcccctccacttggcgcacctggactccctccagctggntcacccccacgactcccatgtgttactggcagctcctccaggacaccagttgnaccgggcgcactacgacctgcgccaacacctttcatgggtgtgggtctcattggggtcaccnttcaggagaagtgtt

SEQ ID NO: 1664 - DNA, 459 bp, Homo sapiens
  misc_feature 219, 289, 318, 422, 442: n = A,T,C or G
gacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggccttgtcccacctgcaggtacctcttcatcngaggacaatgagattggctccatctctaagaatgccctcagaggacttcgctcgcttacacacctgtgcngtgcctccaccgccccagccctccatgangaggcacccatgctccaccccccagggaaacacaagggtatccttggtggcttgctggacggtggccttctctttccttccaaccaaggaaaggcctggggccnaattaaaccaattcttgggnaggaaccccttcccccc

SEQ ID NO: 1665 - DNA, 551 bp, Homo sapiens
ttcggcacgaggagggcttccaccccgaccccaaggccctcaagggcttccaccccgaccccaaggccctcaagggtttccacactgaccccgaggccctcaagggcttccaccccgaccccaaggccctcaagggcttccaccccgaccccgaggccctcaagggcttccaccccgaccccgaggccctcaagggcttccaccccgaccccgaggccctcaagggcttccacactgaccccaatgccgaggaggcccctgagaacttaccctacctctcggacaaagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcac

SEQ ID NO: 1666 - DNA, 574 bp, Homo sapiens
ccgctcaacagattgtccatggaaatgcagaaattaatttcttatgtctttcagtcccttctttccactgaaaatcctatggatgaaacaaaattaggtaaaaggagaaaaggtttgctcttaccccattccaccgcgtcctcctccccgcccacctctgctcatgcctccacgatcaaatccccctcttcccctgccccggttatcagggccactcatgctccggttctctcctggtccggaaaatcctccagactcctgcccataaacacccatgctactggggtggtcctgtcggaatgaacctgaggaaagagtcacatctgtaagccatggaccagcatttacaccactgcctgatgtactttctcctggaatcacaaaatcctcaattccaaggcactaaccaaggcaccatcttctttacatcacgataaagcatccttaataggtaggctcttttaagttcaacaaaactgctggatcatcacagctgaaataaccttatatagttagcctataataaacctcttctaataacaacaacaaaaaaagccctctggctaacatatag

SEQ ID NO: 1667 - DNA, 596 bp, Homo sapiens
  misc_feature 528, 553, 558, 578: n = A,T,C or G
gcttctataggagagctttagaatgaagtcatttagaggagcaggcgaatcctaaccgcatctctctctttagctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccaggtaagaccatgcaacacttctgtgcaacagcagcaggtcagaatgtgctccaagcctgcagagagtgattaggctgagaggaccagaattgagcnaggattggaagcgttaagcccagantttgnattttcttggaatccattgnagtcaatttgggtatggt

SEQ ID NO: 1668 - DNA, 372 bp, Homo sapiens
ttgggggcgcattggggatccaggagcaccagtcgtactggccgaagttgaccgcggcgtgctgggcggaggcggtgaagatcaccacggtcaggtactccgacagctgctcccggctcttgaccgacttggggaagcctgaggacttgcggccccgcatgccgtacacgtagacatcgttcacgaagtcctgcagctccgggtcctcctccaccacctggtcgccctcgtagtagatgtctaccacctcggccgtgaacctggctcagggggcgcacggggtgggcgacccagccaggtctgcggacggtgcccggcggcaaccccctcacggacgctgggactcccccaccccgtccccattcagcgcta

SEQ ID NO: 1669 - DNA, 465 bp, Homo sapiens
cggcacgagggattgttatattctcttgctcagttgacctctttattattatatagtgaccttatttttctcttcttacagtttttgtcttgaaatctattttgactgatacaagtgtagctactccagctcttttttgcttttgtcgccatggaatatctttttttcatctgcttattttcagcctatgtgtgtctttataagtgaaatgtgtttcttgtagacaacagataattgggtcttgtttttttatccattcagagccactctgtgtcttttgatttgagagtttagtgcgtttccattgttattaagaagtaaggatatgttctgccattgtattgtttgtcttttgcttgttttgtggtcttctcttcctttcttcattccttcatttcttttattgaaggtgattttgtcttgtggtatgatttaatttcttcctttttattttttaggtatatg

SEQ ID NO: 1670 - DNA, 533 bp, Homo sapiens
  misc_feature 137, 228: n = A,T,C or G
tcggcacgaggggcaggaaatagtctggcagcctctacagcagaagaaacggcaggcagtgcccagggtcgtgcccaggaggctgagcagctgctacgcggtcctctgggtgatcagtaccagacggtgaaggcccntactgagcgcaaggcccaaggtgtgctggctgcacaggcaagggcagaacaactgcgggatgaggctcgggacctgttgcaagccgctcangacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctaacactgccccacatgcatgtctgcctatgcactgaagagctcttggcccggcagggcccccaataaaccagtgtgaacccccaaaaaaaaaaaaaaaaaaaaaaaattggggggggc

SEQ ID NO: 1671 - DNA, 648 bp, Homo sapiens
  misc_feature 290: n = A,T,C or G
tcggaacgaggacgatggggagaacctgtcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctancgctgctgaccgagctgtgccagcgcgtgagcttctgcactgacatggaccccgagccgcaaaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccacaaatggctgcaccggtgatgccaatgggcatctgca

SEQ ID NO: 1672 - DNA, 517 bp, Homo sapiens
tcggcacgaggaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccggcgctcccgggccagggcgagcgcggcgaggggcgcaccgaccggttcgcagcggggcgggagtccgagcgcgcgaggagcggcggacccgggtccttgcggga

SEQ ID NO: 1673 - DNA, 615 bp, Homo sapiens
  misc_feature 84, 493: n = A,T,C or G
tcggcacgaggcgggcactggaccgcagaactggcactcgagtcccaggggccggaatgcgcttggagggagagggccgctcancgagggcgggacagaacctctcccgggctgggagtgcacggcgcggtgcgcccagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctgtcccggagaggagctttgaggggctgtcctccctccgccacctctggctggacgacaatgcactcacggagatccctgtcagggccctcaacaacctccctgccctgcangccatgaccctggccctcaaccgcatcagccacatccccgactacgcgttccagaatctcaccagccttgtggtgctgcatttgcataacaaccgcatccagcatctggggacccacagctt

SEQ ID NO: 1674 - DNA, 229 bp, Homo sapiens
gcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttgagaacctgaagaaccttcacgcattgattcttgtcaacaataaaattaccaaagttagtcctggagcacttacacc

SEQ ID NO: 1675 - DNA, 55 bp, Homo sapiens
gctgtcgggagagcccaggattcaacacgggccttgagaaagtggctcttgtacc

SEQ ID NO: 1676 - DNA, 55 bp, Homo sapiens
ctggactcgcgcgccctgcaggtcgacactagtggatccaaagaattcggcacga

SEQ ID NO: 1677 - DNA, 482 bp, Homo sapiens
acagaagggctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggag

SEQ ID NO: 1678 - DNA, 520 bp, Homo sapiens
gactcccgagctctactgactcccaacagagcgcccaagaagaagatggccataagtggagtccctgtgctaggatttttcatcatagctgtgctgatgggcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcag

SEQ ID NO: 1679 - DNA, 352 bp, Homo sapiens
tcgcgccgccctgcaggtcgacactagtggatccaaagaattcggcacgaggcaagatgggtcaccagcagctgtactggagcacccgcgaaattcggccagggttctcgctcttgtcgtgtctgttcaaaccggcacggtctgatccggaaatatggcctcaattatgtgcccgccagtgtttccgtcagtacgcgaaggaatattcggtttcatttaagttggactaaatgctcttccttcagaggcttatccggggcatcttactcaatgaaaaaccatgataatttctttgtattaattaaaataaacattttgaaaaaccccttcaaaaaaaaaaaaaaaaaaaccc

SEQ ID NO: 1680 - DNA, 516 bp, Homo sapiens
cggcacgagggtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaccttttggggccgaaattttttccctttaagggggggtaatttta

SEQ ID NO: 1681 - DNA, 262 bp, Homo sapiens
tttatctatatatatatgtttatttatttatttcatctttcctttttctcaggagtgaagggctcactgggtctgttgagaaccaggtcagatcaggaggtcgaggtcagttctgggagctctgtggtctccatgtcataatggttctttccgtcggaataggtcttccccttcaagacctctatgagctgctgtaggcgcttggcaaaagaaagtccttggggaagttttgtggtagatgagggtgtagggtggggggggg

SEQ ID NO: 1682 - DNA, 574 bp, Homo sapiens
tcggcacgaggtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacact

SEQ ID NO: 1683 - DNA, 599 bp, Homo sapiens
cttgacagaaaaaccatctgtgctggggctttgattgcgaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtggggcaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgaaggtgttttccgaggggtcacttcctttggccttgaaaataaatgcggagaccctcgtgggcctggtgtctatattcttctctc

SEQ ID NO: 1684 - DNA, 474 bp, Homo sapiens
cccttccgggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaagcataccaagatccacttgcggcagaaggacaagaaagcagacaaaagtgttg

SEQ ID NO: 1685 - DNA, 488 bp, Homo sapiens
ttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcacccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacacccc

SEQ ID NO: 1686 - DNA, 452 bp, Homo sapiens
  misc_feature 452: n = A,T,C or G
gtagctctcttagaaattttattggtcctggagaaaggaaggcaaactctgcctcccgctcagagtccccccaaccctcactgtttcccgttgccattgatggggaggttcacgtactcatgggaggccaggaaggcttggagcttgggccgggcactgaggcgccccacatatgctgagagcagggggaacgcatccaggcagcagggtctcaaaaggcttcagttgcccgggcagtgcttcacatagtcatccttgcccgcctcatagttggtgtagatgagggagatgtatttgcagcggaggtcctccacgccgtcattcaccatgtccaccaagggctggcatcctgctggtccttcccatagagcccaagggtgcggcccagggtgacgcaggatggtattggactggtaaagggtgaggtctccgtcctggaacttggggagctn

SEQ ID NO: 1687 - DNA, 460 bp, Homo sapiens
  misc_feature 389: n = A,T,C or G
tcggcacgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctanaggcaccaagggaaggccccattccggggctgttccccgaggaggaagggaaggggctctgtgtgcccccc

SEQ ID NO: 1688 - DNA, 531 bp, Homo sapiens
ttcggcacgaggctgaagtgggttggccaggaggttcccccgaccggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcaaattttctaagaaccaaaaaaaaaaaaaaaaaaaatgcg

SEQ ID NO: 1689 - DNA, 542 bp, Homo sapiens
  misc_feature 404: n = A,T,C or G
cactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttangccttgggtggctggaaggctttgttaagggactaggagaaatgggggtatctttcccctttcctgccctttctgctcatctcaacctctcacagaggtgtcttctccccctaacctacagctttttgtacaagccat

SEQ ID NO: 1690 - DNA, 579 bp, Homo sapiens
tcggcacgagcactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcag

SEQ ID NO: 1691 - DNA, 501 bp, Homo sapiens
  misc_feature 349: n = A,T,C or G
gacttggcacgaggtacacatctggtgctggtgtccaccttctgcaggactgtgttcccgaaaccctgtgggagctgggctactggctgtgctacgtcaacagcaccatcaaccccatgtgctacgcactctgcaacaaagccttccgggacacctttcgcctgctgctgctttgccgctgggacaagaaacgctggcgcaagatccccaagcgccctggctccgtgcaccgcactccctcccgccaatgctgatagtcccctctcctgcatccctccaccccagtccccgggaaaggccggtgggaagagggcaggggctgcatcctcagccccagggccctgctcangcctcacctggcttcccaggaccctgggtcaccttcctgggcagcccaaagagaccctgccaactttccagacttcgctattcccaggcagggagggaaacccggggaactggtttttctgttccctgctgggtgggaatgcgctcttcacc

SEQ ID NO: 1692 - DNA, 438 bp, Homo sapiens
atctcgaaatagttgattccatacatttccaggtcctgagcaatcttcaggtattccaacatagcattatctttgagcatcccacggtgttccgcatgccacacctggatccggtcctcccactggtccctggtaagtttgtgctggtccatcactctttgagggatcagccgctcagagctgaggtacccagacttgtgcacttctttgttgtagtccccaaacttggcctgcacagcgtaggaccccaagagcacggcagtctcaggggggcagtagatctcatcgctaaggattccttccttcacttggaggaagaaaagtttctgggtgatgtcctggatgagctcctcagccacatcttcagggtagaacttggcccggaacttgaactggaggggattctccttcctgacctcctggggcagacaccttctt

SEQ ID NO: 1693 - DNA, 436 bp, Homo sapiens
  misc_feature 85: n = A,T,C or G
ctgtggcaaagatctcatctctggaggcacgggcatcttccagctctctttgaaagtccttcatctgagcctgcagtttgcgtantgcttgatggcttcctccctccccttgatggcagagtcggcctgaagctccaggtctttcaggtccccttccagcttcttctttgctgcagctgccagggcacgttgctttcgctcgtcttccagttccgtctcatactcgtgaagctgtctctgcagttgcctcctcttctcctcattctgctcgtcccgggcttggagatccctttcgaactggcccttgagcgcctgcatgttgacttccagccgcagtttggcgtcctccgtggcttgcagctcgtcctccagctcttccagctgcgtcttcatctcctccatctgggtctccagggcccgcttggacttctccaga

SEQ ID NO: 1694 - DNA, 582 bp, Homo sapiens
  misc_feature 331: n = A,T,C or G
tcggcacgagggagtaagtttgaggaacctgataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtangggaggggttgccacaggcctccctgtttgaagcctgcccttgtctgagatgctggtaatggccatggtacccccttctgggcatctgttctggtttttaaccattgtcttgttctgtgatgaagggaggggggcacatgctgagtctcccaaggctgcgtctggaagggcccctgcttctccagcctggacccccagctttgcccaacaccagcccctgccccagcccaagtccaaatgtttacagggag

SEQ ID NO: 1695 - DNA, 373 bp, Homo sapiens
ttggccccacccccggcggggccacgggggccagcggccttggtgtgcgggccccggacacgaaggccccaaaagtcacccagccccctatgggcccaaatctccttcagccgccccaggtcttcacggagcttgtcgcccaaaccattggcaaggaccggcctgaaattcccacccttaaaacccttcggcctgtccaaaaaccagtcggggaccttcaactggcggggattccgcaaaagggggaccacacgttccaccacacccccagtgagcccccccccccccttggggaggcccaacggtggttgcccacaagaccactgggcaaattcttgggcccaaaccctaaagggcagtgatgcgaaaggct

SEQ ID NO: 1696 - DNA, 339 bp, Homo sapiens
tcggcacgagggccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccaaaaaaaaaaaaaaaaaaaaaaaaaaaaaaaaaaaaaaaaaaaaaaaaaaaaaaaaaaaaaaaaaaaaaaaaaa

SEQ ID NO: 1697 - DNA, 491 bp, Homo sapiens
ttttttttttttttttttacaaataaacggggcttttattgtgtgtccacaaaaacaaagtcagggtggcctttggttaatcccctccccccaacaagatgacaaaaggaggaatgcatgtcaacaaaatgacaaagaggaccatggagggcctgagtctgctgcctccctggtgggacaaggcagggggagcaagcactactctgggctaggccagcgccccccaagcaaaaacacataaagcccctgcccctgcccccacccccacccccactgctaaggcagtcagccaggacttccccaaagacctagctctgaagcccagaccctcatggctccctctagaaggggttgccttcttcagcctgcatgaagtggtaaatgaagaagaggacgatcacaaagaccaggaaaagcagcagctggccccagagcgggacctggcgatcctggcccagccagccccaggagcacggttttcaggccggatg

SEQ ID NO: 1698 - DNA, 518 bp, Homo sapiens
  misc_feature 109: n = A,T,C or G
tcggcacgagggccctttctccctccgcctccatccttgtcttcctcttccatcttttcatgatgggaaatctcatctgaaccttgttccctctcctcctcttgtttangctcttctgaactgatctgcccattttttaatgacattaccactgtttcctcctggctttcagttgttttctcttccaccatcacctctacctgattttctccaatgctccctcgctttggcttctcctcttcctcctcctccttttccttgtcttctttcttgttttcttcagcatccctccaatcattcttctggtaggacttggtgactgtttctgtttcctctatctcgtatctttcttggcgactttcacttttttcttccttctcggtagtttcattttctgctgtgtcattttgcattcttctgcttgggagcgacagacttgcatctgttattgttgggtcgaactccttctgccgctccagagcctcctgaaggcgtttttggcgtctttcctcacgccg

SEQ ID NO: 1699 - DNA, 495 bp, Homo sapiens
  misc_feature 301: n = A,T,C or G
tcggcacgaggttgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccangacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttaaaaaaaaaaaaaaaaaaaaaattgggggc

SEQ ID NO: 1700 - DNA, 476 bp, Homo sapiens
  misc_feature 372: n = A,T,C or G
atcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagaacaggcaccgcctccaggacaacgtgcgcgaagacctctatgangctgctgacaagtgggtggctgctgtgggcaaggaccggcccttcatggggggccagaagccgaatctcgctgatttggcggtgtatggcgtgctgcgtgtgat

SEQ ID NO: 1701 - DNA, 453 bp, Homo sapiens
tgctaagaattttatatatttacaaatatatcacatttaaagacatctgaataaaatatcaaagtttatactagtgtttttccccttgacatcacatcctcgcttctgttttcgccatgtgacatgcaagtttggccttccaccatgattgtaagcttcctgaggcctccttagaagccgagcagatgccagctccatgcttcctgtacagcaatctttcaaggagacctaacccagaaaatgagccattcttcagctcggatatcttattgttactcagaatcagggtgaccgtgcggttgggcagagtatctgggggcaggacctgcgcgagttccaggctgctgcacaccaccttgccctcggcggcgcccgccgccctgccagcccctcggggccgcccatcgtgcttgcagccggcgggcagcgccgcggcgccgccgccgccgccgc

SEQ ID NO: 1702 - DNA, 347 bp, Homo sapiens
  misc_feature 201, 204, 208, 307: n = A,T,C or G
attcggcactagggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaanatncatnctctcccaacttcagcttcatgggccagctgctgcagtttgagtcccagggtgctggctccgcactgttcggcagaggctggggagccccgccatgggntgtgctcgaccgagggcaccttcaccaccaccgtgtttca

SEQ ID NO: 1703 - DNA, 357 bp, Homo sapiens
  misc_feature 306: n = A,T,C or G
tgacggagccgagtctccaattgtaggctctacggaaatgaacttgctggtcctgcccaggcaaatgggcttagttccctatttatttatcctccagcaacagaactgagttcactcggtatctgaaattgacttttccagcagaaagtttttgtgggtatgggcactggccttggctttgagcaagcttgatgaatgttggatatttctggatttcagggtggcccggtggaaatcctgccctttctgtacctgggcagtgcgtatcacgcttcccgcaaggacatgctggatgccttgggatanactgccttgatcaacgtctcagccaattgtccccaaccattttgagggtca

SEQ ID NO: 1704 - DNA, 118 bp, Homo sapiens; identical to SEQ ID NO: 275

SEQ ID NO: 1705 - DNA, 51 bp, Homo sapiens
tgtctcacctgtgaaaaatcagggtgcctgcggcagttgctggactttctc

SEQ ID NO: 1706 - DNA, 464 bp, Homo sapiens
cgggtagaagtggaggggccgttcgaagagtcgtgagggggtgacgggttaagattcggagagagaggtgctagtggctggacttgacctggaaagaatcttctgctgactctcaactttttcctgggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggac

SEQ ID NO: 1707 - DNA, 558 bp, Homo sapiens
tcggcacgagcagaaacaacttttttcacaacgggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctct

SEQ ID NO: 1708 - DNA, 481 bp, Homo sapiens
tcggcacgagggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgac

SEQ ID NO: 1709 - DNA, 479 bp, Homo sapiens
gggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctatcattttacagagtatttcaatattccttatgattgggaaagaatgccaagatggtattttcttttggc

SEQ ID NO: 1710 - DNA, 587 bp, Homo sapiens
acagaaggggaatgtgataagttctttaaaagaggtaagagcaacgtgctttgggagcagagaagagggagaaagcagcatcttgcccggatgagccaggggacacagaagagaagcccactatctcatttaatctttacaactctcttgcaaggttccctggttgtgaaaatacatgagataaatcatgaaggccactatcgtcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttgagaacctgaagaaccttcacgcattgattcttgtcaacaataaaattagcaaagttagtcctggagcacttacacctttggtgaagttggaacgac

SEQ ID NO: 1711 - DNA, 524 bp, Homo sapiens
tggatcccccgggctgcaggaattcggcacgaggtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcct

SEQ ID NO: 1712 - DNA, 478 bp, Homo sapiens
ccgctgcaggctgcgcggatgcaggaggcacggggtggcgtggggtcgcatggctgcaggcttcggcgttcagtgattgtcgctgggcacagggggcgggcgctgggtgccagggaagcctggcacctttctccacaaggccgggccaactggcggcttgcatgtcttccacaaggggcttcaaacagcctccttgagggcgggcctggaaggtccggcctgccaggggtatctggtggggcctgttcttccagcttgggcggactcccgcaactggtctttcactctgtcaggcggtcgcgggtccggctgcccatctcttccatccgcgcgggagggttcggcccaggcttgggccgttcttttagcggtggcggtcaggggagccaaagtgggggccccagcgggcctgttttaacaaggggcccacgggctcgggaatgggtgggaggggcggcctggcgcctcgcggcccccg

SEQ ID NO: 1713 - DNA, 424 bp, Homo sapiens
agagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaag

SEQ ID NO: 1714 - DNA, 622 bp, Homo sapiens
  misc_feature 486, 570: n = A,T,C or G
cggcacgagggcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttantgtccttcttaacagactcaaaccacatggaccacgaatattctttctgtccagaagggctactttccacatatagagctccanggactgtcttttctgtattcgctgttcaataaacattgagtgagcacctccc

SEQ ID NO: 1715 - DNA, 449 bp, Homo sapiens
gctctgctaattttttattgttgtgtaatatatggagtcgcgctacttggtccatgctgatctcgaactcctgagattcattgatcctcccatctcggcctccccttctgcatattgtaggtgctcaataatgacctaccatatgcaggagttgatgtactcattgctcgggactttgttgcttgggtgaccctgaccttcatgctcctgcaccctaggcctggacgctgtcgatccaggtcgcatagctcgcctcgcgtgtgtatatcccgggcttcttgcggtatccgaaactcgcgacccgaggtgatcacgctctcgagcatgcctttgcatactagcgtgctcccggagtcatccttgcagctgtcccggtgattgctcttcgcgcacatcaagcgctcggtgatggcgccttcgtggttcgtgcgcctgatgcaggtggcgcg

SEQ ID NO: 1716 - DNA, 266 bp, Homo sapiens
aggagcctaagcaagaacagcttaagccccgacggggggtgccccccccccttcagaggcctgggcggggggggcggcagccccgtctcccggggggggcggggcgcccccgtcctcaggggggggttgctgtatgggcccagggggcccctgtaccccttcgggccggtctgcaaccccaggctgggtggcggtgaacccaggggcgggagagtccattcccccggaaatcccccctgggtcgcggccttcccagcagcagcctg

SEQ ID NO: 1717 - DNA, 403 bp, Homo sapiens
  misc_feature 310, 360: n = A,T,C or G
acaacgaggaaacagcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccangctgcctgagcacctcccagcccctgcccctcatgccaaccccgccctangcctggcatggcacctgtcgcccagtgccctggggctgatctc

SEQ ID NO: 1718 - DNA, 603 bp, Homo sapiens
ttcggcacgaggctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgctt

SEQ ID NO: 1719 - DNA, 571 bp, Homo sapiens
  misc_feature 444: n = A,T,C or G
tcggcacgaggacacaactgtgttcactagcaacctcaaacagacaccatggtgcacctgactcctgtggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcanaaagtggtggctggtgtggctaatgccctggcccacaagtatcactaagctcgctttcttgctgtccaatttctattaaaggttcctttgttccctaagtccaactactaaactgggggatattatg

SEQ ID NO: 1720 - DNA, 430 bp, Homo sapiens; identical to SEQ ID NO: 333

SEQ ID NO: 1721 - DNA, 472 bp, Homo sapiens
  misc_feature 197, 393, 428, 441, 453, 459, 464: n = A,T,C or G
ttatagcagaagttgtgggagacgggagggcaccctccacacatactacagtgtggtcagagccccagggtagccctttccaccctatgccaagccccaagcagcccagcccaagcttagctccctccccagtcccactctagatgcacactgagctaccaaagttagtgcagccaaacggccccaggcccttcctnttgccccagcaccaatccttccccacactcgttcactgcccgccaactcccattccaacttcctttttacactggatgtttctatcacatcctgaggaccactaacccaccagcaagtttccccctgaacacacattcacgtagggtccataaccctttcagagtcctaaaagggtttaattgagaaggccacctnaagttttggtgaattgggagccccagccccaaatncctttccctttgnaattatgggggnaagtanggggngatttttt

SEQ ID NO: 1722 - DNA, 543 bp, Homo sapiens
  misc_feature 465: n = A,T,C or G
tcggcacgaggagcagagaccaccctctgatgacggtgggcgtcctttccagcccctctcggggcatcgcttcatcccttcccccatttccttcctggccctgctctccaagtcttgtgtgtgtggtggggcctggcttccctcccggcctctcgcctgttcccgcccatccctctctggttctctcaggcctcctctgggcttgccaggaatgtaggggaattagggggagggggacacaggaaatgcctcccctcctctgacaacagctccagctgcagggggaggggggaggggagagcagagtgggtgagacgagggagggctgaaggggggagtcggcttggggggagagtgttctcctgcccacccaggcactgggcgtggcccagccccacagacagaacagttctttcttccttattttattttttattagagacagggtctcactctgtcgcccangctggagtgcagtcgtgtgattggcctcaagcgattctcccacctcggccttccaaagcgctgggattacagcagtga

SEQ ID NO: 1723 - DNA, 490 bp, Homo sapiens
tcggcacgagcttccttcaaattaatgaccttggattacataaggatttctatgcattcattataatttgttattcctttcaatatccttgtatttcaaatcttccatataagaattagacatggcaattcttaaattgattcagaatggtctgatactattccagtatcacctccttaattctgtttctcctcgttttcctgattttccttctcattctctccttccccgctctgtctctctctccctgtcactctctctctctcgttccttattttttgtttcttacctcttactgtttaacctgttgcttccttctggattaatacatttagagccattcctttatatggtcacatttcctatgactttactcaattacttttaaaatcctttctattctgagactaatttttaagaattacaaagctcattcttctgaatctaatatcactaactcctaaactttttccgttttctttggatacac

SEQ ID NO: 1724 - DNA, 607 bp, Homo sapiens
  misc_feature 560, 585, 590, 603: n = A,T,C or G
aaattacttcgaaactttaattacagatacttttccacgcaacatttctgaaatgaaagctttgattctccccttttcttgcataaaggctgggaaggtggtttggccagaccgtacatctttttgtatatacatatctacacctgtgtctcttctttattaataaaaggtgtcttgatcacagtcccaaaccaactctgcattggattccagcatataaaactcagagagtaaaacaattttaaaggaagacaggctgcaaccacaggaaaatggcaggaaaagttgtagcttgatagttgtttcttctaagtttaactcagaaatataataataattaagagaaaaaaataagaggccctagctttcatccctgctaccaaacacgctcgtccagaactctaggctgtcttaaagtgcaattactggttgtgaagttgctcaggccagggatcaggctggacggagttcaaagcagaaacttcaaacactccttgctggttcatgactcaggggctgggggcgcccggagaggagaaacaagaaaggacagttctctnggcattccaagtgcctcaaaggatnaatgncctttcctttggnaaag

SEQ ID NO: 1725 - DNA, 484 bp, Homo sapiens
ggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatc

SEQ ID NO: 1726 - DNA, 486 bp, Homo sapiens
  misc_feature 4, 477: n = A,T,C or G
gcgnccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtgggctgagttcttcctcgcgctacgggcctgggcaagaaggaaggatgnatccttgaa

SEQ ID NO: 1727 - DNA, 502 bp, Homo sapiens
tcggcacgagggagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactg

SEQ ID NO: 1728 - DNA, 581 bp, Homo sapiens
  misc_feature 133, 259, 321: n = A,T,C or G
tcggcacgaggcaaatttatattttttaatatcggggggtggaccacgccgccctccatccgtgctgcatgaaaaacattccacgtgccccttgtcgcgcgtctcccatcctgatcccagacccattccttanctatttatccctttcctggtttccgaaaggcaattatatctattatgtataagtaaatatattatatatggatgtgtgtgtgtgcgtgcgcgtgagtgtgtgagcgcttctgcagcctcggcctangtcacgttggccctcaaagcgagccgttgaattggaaactgcttctaaaaactctggctcancctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccaactgtcgtctgactctgggttcgttggggacatgagattttattttttgtgagtgagactgagggatcgtagatttttacaatctgtatctttgacaattctgggtgcgagtgtg

SEQ ID NO: 1729 - DNA, 570 bp, Homo sapiens
  misc_feature 431, 443: n = A,T,C or G
tcggcacgaggcacaactgtgttcactagcaacctcaaacaaacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcangctgcctatcanaaagtggtggctggtgtggctaatgccctggcccacaagtatcactaagctcgctttcttgctgtccaatttctattaaaggttcctttgttccctaagtccaactactaaactgggggatattatg

SEQ ID NO: 1730 - DNA, 543 bp, Homo sapiens
tcggcacgaggcgaccccctgacccctgagttcatcaagccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccacc

SEQ ID NO: 1731 - DNA, 509 bp, Homo sapiens
  misc_feature 184, 385: n = A,T,C or G
tcggcacgagggatccctgcccctccaggtgtccagggtaaagtgtaactcaaaccgacctgtggggcacagggggcaccagctggccttgccctctctggtctgggctgtctaccttcctcactgtatctttgcccaaacccacctgggccagtaggcccctgtccccagccacacaccttanatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctctgatcctcangccctacctgtagagacctccactcctagagccagtctcagggtctgggatttccctgcaggagctcagccaccactgtgccatggtgacacaggccaaggcagacattggccctcccttctcc

SEQ ID NO: 1732 - DNA, 440 bp, Homo sapiens
  misc_feature 284, 367, 416, 432: n = A,T,C or G
agtttgtcatgtttgtctttattcatctttccggatcttggtccccaccgccagcacccacccaccccacccccaacccccactgtcctgaccacctggagccaaaagcctcttttcctaggtccagagtcctctctccctctggccagagcctcagagtgggaaagggaatccctggccctcaaggaggttttctctcagacaggggagggtgagggggcagctagtctccgagctgggcaggtctgacttcccaggttaccccaggtgagcttacctgactntgggcgccggcagtgagggccagaacaacacccagtagggttaagggagggccagcagtgccagggttcaagagccccaggtntttttaagagattgagttaaagcagggtgaagggccaagcccagttccntcagttgcccagcttnccttttta

SEQ ID NO: 1733 - DNA, 514 bp, Homo sapiens
  misc_feature 218, 311, 395, 452, 455, 492, 497: n = A,T,C or G
ggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggancgtggctgcccagggtgcccgggtctacgcctacgtctttgaacaccgtgcttccacgctctcctggcccctgtggaatgggggtgccccacnggctacgagatcgagttcatctttgggatccccctgggacccctctcgaaactacacggcagaggagaaaatcttcgcccagcnactgatgcgatactgggccaactttgcccgcacaggggattccaatgagcccgaganccnaaaggccccacaaatgggccccgtacacggcgggggnttcancagtacgttagtctgga

SEQ ID NO: 1734 - DNA, 588 bp, Homo sapiens
  misc_feature 95, 429: n = A,T,C or G
tcggcacgagggggagccactgtgcagaggctcccagtctgctgcatagaaggacccagataggtccatgtctggcacggagcgggctgtctcanaaccactgggcctggatgatgctgggaacaggaagtcatcaaagggctcggtcttcagctccatgctgctgatgctcttgacaggttccactgagggcttgggctcagggtcattgaggagaggcagggtgaaggcctcctcagactccggggtggcaacctctggcaggcccccagtcagatcaagggaagccacagacatctcttctgggaagcccaggtcatcagggatcttgcaggcaggtcggtgagctgccaggatgaactctagtttttccttctccttcagcaggttggcaatctcggtctgcaaagcagacttctcatcttctanttggtctgtctccgcttggagtgtatcagtcagctccctcctccggttgcggcatttggctgcagccatcttattcctttcccttcggattctccttttctcttcttcttctggagataactgttccaccttgcccctcctgccaatgctctgcgctcg

SEQ ID NO: 1735 - DNA, 517 bp, Homo sapiens
tcggcacgaggattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctc

SEQ ID NO: 1736 - DNA, 488 bp, Homo sapiens
tttttgaactcggcagtcctttatttagatcaatgcggggctgaggggccctcattccactgcagggcaaagggggaccaggcccaaggaggcctccttctgcccaaggtctggaggcagagaggggctcgcaggcggcccgagggcgcgcatccaggccccggagcgcaaagccttcctcccagggggaggcagtttcccatccaccgaccaggtttccccggagagtcccagcacaaaagcagcagcgggcggtggcctagaaggctcagagcgcacgcagggggacacaggcggggagctcactcctgggcgagcatcctcgcgaactcctcgtagttcacccgcccgtcctggtccacgtcggcctcgcggatcatggcgtccagctcctcctgcggcagcggctgccccaggcccgccatggcccgcctgagctcgtccacggtgatgtggccgtcgccatcctggtcgaaggcgcggaaagc

SEQ ID NO: 1737 - DNA, 554 bp, Homo sapiens
  misc_feature 417: n = A,T,C or G
tcggcacgaggctgaagactgtgattacatgcacctgccttagaaggtaggattttcttcccaggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttangcgtcacgccaaaggccagcctcctggccccaatacccattttggaagcccctgtggccgtgtggatgtcggtaacagttgtataaaataaattctatttatcgctattgtaaaaaaaaaaaaaaaaaaaaatgcgg

SEQ ID NO: 1738 - DNA, 519 bp, Homo sapiens
ttcggcactagggatcctcgtccgacaacggggatgcaggccccgggccgtgcacacagggccgtcagaggtgatggtgtgcatctttagcaggtggcacaactggcgctgggaactgggggtcccttccctcacgagtccttatggaggcagaccctcacccagtgagggcacggagcccccgggggccctggagggaggagcgaccgcatgctctctgggccccgtgactgctgtgactcaagttcctttgcaagtgtgcacagcagggacgccctgactctcgccctctccctggcaggaggtggtccaagccacgctggtggtcctggccttggccatggtgcccatcctgctgcttggcacacccctgcacctgctgcaccgccaccgccgccgcctgcggaggaagcccgctgaccgacaggaggaaaacaaggccgggttgctggacctgcctgacgcatctgtgaatggctggagctccgatgaggaaaaggcggggggcctggatgatga

SEQ ID NO: 1739 - DNA, 338 bp, Homo sapiens
tcggcacgaggcattttttttttttttttttaaagcctcgagggctttttccagtgggggctcaacaatctttttaaatcggatggcattttccacctggttgttaaacaaaaccgtctcctcctaaaatcgctaaatctcatgcttaaacccttcgaattcaacctggttctgcttcaacgggaacactattttctgcaatgggatattttttttttccaattcaatatacccctaaaggacccgggcctcccgaaacttatattctcggatttcatccttcatccgaattctctgaacctccaccatctaattgttctccttaaaaacctgcacaa

SEQ ID NO: 1740 - DNA, 353 bp, Homo sapiens
cccttaattttcctggaaaaaaaaccccaggtggaagccaaagcgggagccggagcccgcggcagggaaacccgggggggggccttaacgggggggccagggacccccggaaggggaaactgggggaaaaaagccccctcccaaaggccgggggccgggaacctggaggcctaaaaaagggcaccaaagggggcctggggaagttccccgggggggcattgaacccccgggcgagggtgaaacagtcacggaaaccagccaagatgagcagcttcttaggcacagggggggggaagagccaagtcccccggggtcaaggggagaggggtacaagaacaaagccggagggcctg

SEQ ID NO: 1741 - DNA, 544 bp, Homo sapiens
tcggcacgagggtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggaagatgtgacagcaagggccacggaccccatggcaggggtggcgtcttcatgaaggaagggcccaaagcccttgtgggcggacctcccctg

SEQ ID NO: 1742 - DNA, 600 bp, Homo sapiens
  misc_feature 96, 238, 414: n = A,T,C or G
cggcacgaggaggctcccagcctccttcccgctacagaatcgctcatcggcgaggctcagcagaaagaccctgaaggcaggctgcaaatgacccanaagagggacctgggagtcctggtggggacggggagggagtctcaatactcctttgcagtgcaaggtactctgagtcccctctgtagtgcctctgccagacacacactgcctgagttgaagagacacaggccacacatttcangctggttgccagcggacgtcagcactcacggcctgcagggactcagcacagctctggattctggatctctcctgctgtaaccccacgcacaagcctgcaacccccaaagctctttgacaggctcccaggcctcccagtcctggacaagcatgtgcagtcacgggagctcagctcangccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactaaaaaaaaaaaaaaaaaa

SEQ ID NO: 1743 - DNA, 541 bp, Homo sapiens
tcggcacgaggagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctcctcacatccgcacctgctgttcccactccggggttctcaagtccatgaacagatattgttgcattttccacaatgctgattaaacataataaacaatccagaaaagcagttttgcccagaaaaaaaaaaaaaaaaaaaaaaaa

SEQ ID NO: 1744 - DNA, 620 bp, Homo sapiens
  misc_feature 512: n = A,T,C or G
tcggcacgaggctgacttgcttccggagtttattgtgcaggatgaagcccgagtgggcaggggtgctttggcggggagccggggcaggggctcggggaaggaacagagcagagacatccagagcgtgggggtcacctggctggccgggatcccagcttcagccctggggagtcctattgttccgtcatgcacttatcggtttggggcaggaagacaatggtatcctctgtgaagccctgggccttgcagaaggcggtgaatttctcctttaactcagccctgggggtctgggttcggctgtagagggtggccatgcggaagtcctcgccagggcccttgctgccctggctgtacagcagcgcgtactggtcgtagtcggtctccaccactgacacggagtaggtgctgccccagtggggactccggtagctgtaggagccgagggaccccgcgggctgcagcagcatggttcgggtctcacactggtttttcctgaggaaggtggaggtcangttgaggccaccatccgtggcaggggccaccacagacttgcacatggacaacgccgccttcttctcccggagccagctcgagttggcggccgcaagcttattcccttt

SEQ ID NO: 1745 - DNA, 505 bp, Homo sapiens
tcggcacgaggcaatttagcctcagtcgatttgaacatatttttctttttcccttgaatttcccttctttttggctaaatgtcacctgtcctccaactctctagtgatgtctcctctccaggaaattttcccaagcccgactggattgtgtgtccccctccccccggcatagttggggacaaaggggaaaaaggtgctcggggcttaaatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaa

SEQ ID NO: 1746 - DNA, 528 bp, Homo sapiens
  misc_feature 46: n = A,T,C or G
tcggcacgagggatctgaagacagcatgtacacagccattccccanagtggctctccattcccaggctcagtgcaggatccaggcctgcatgtgtggcgggtggagaagctgaagccggtgcctgtggcgcaagaaaaccagggcgtcttcttctcgggggactcctacctagtgctgcacaatggcccagaagaagtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcct

SEQ ID NO: 1747 - DNA, 370 bp, Homo sapiens
attcggcacgagggcattctcacccgcagcacctttgaaagaaaaagacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccac

SEQ ID NO: 1748 - DNA, 535 bp, Homo sapiens
tcggcacgagggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggacctccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaaaatggacgtcaagtctgccctgagcatcgtgaggcagaaccgtgagatcggccccaacgatggcttcctggcccagctctgccagctcaatgacagact

SEQ ID NO: 1749 - DNA, 135 bp, Homo sapiens
gagtgaccaggagccgctgtacccagtgcaggtcggctctgcggacgctcggctcatggtctttgacaagacggaagggacgtggcggctgctgtgctcctcgcgctccaacgccagggtagccggactcagctg

SEQ ID NO: 1750 - DNA, 395 bp, Homo sapiens
gagccccaagcttaccacctgcacccggagagctgtgtcaccatgtgggtcccggttgtcttcctcaccctgtccgtgacgtggattggcgctgcgcccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcatgaacataagcgtggtcttgctgggtcggcacagtctgtttcatactgaagacacaggccaggtatttcaggtcagccacagcttcccacacccgctctacgatatgagcctcctgaagaatcgattcctcaggccaggtgatgactccag

SEQ ID NO: 1751 - DNA, 493 bp, Homo sapiens
  misc_feature 389: n = A,T,C or G
ttcggcacgagcctctgtccagcagagaggaagagaccagacttactttgtgcagccgcagcagctgttcagacttatgagcagacaggaactgccagagggcaatggtgtgttttaactggcatctgtttaaggcctgcagaaggaatagaattcctgagtgggggctgaggtctcacacccccactcatgtcgtgcaccagggagcctgagtgctctccacacaggcattcttctcttcgttctgccctgtactaatgtgatctccctccttgtgaaggccatctctgtcctatctaccagttccctcctgcggcacctcacagcccgctcacatcacgctgtttgcaggggcctcatgtactcagtcacatttgggctctatctanactgctggcatttctagcgcgtgtctgtctctactgtccctggtgtgtcctgtttatgctggactgactgggtgagcagttgttcttgtctccccatccttttc

SEQ ID NO: 1752 - DNA, 504 bp, Homo sapiens
  misc_feature 200: n = A,T,C or G
ttcggcacgagtaaaaggttccctggttgtgaaaatactgagataaatcatgaaggccactatcatcctccttctgcttgcacaagtttcctgggctggaccgtttcaacagagaggcttatttggctttatgctagaagatgaggcttctgggataggcccagaagttcctgatgaccgcgacttcgagccctccctangcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactct

SEQ ID NO: 1753 - DNA, 377 bp, Homo sapiens
acagaaggggaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgccctctgcctcaggaacaaaagcgtgatcttgctgggtcggcacagcctgtttcatcctgaatacacagaccaggtatttcaggtcagccacagcttcccacacccgctctacgatatgagcctcctgaataatcgattcct

SEQ ID NO: 1754 - DNA, 475 bp, Homo sapiens
ccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaagttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccaaaaattggcagagcagtttgtcctcctcaatctggtttatgaaacaactgacaaacacctttctcctgatggccagtatgtccccaggattatgtttgttgacccatctctgacagttagagccgatatcactgga

SEQ ID NO: 1755 - DNA, 452 bp, Homo sapiens
ggacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagaccgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacaga

SEQ ID NO: 1756 - DNA, 486 bp, Homo sapiens
gctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagagagaaagagaaaatcagttcgtggttgcattgtggatgcaaatctgagcgttctcaacttggttattgtaaaaaaaggagagaaggatattcctggactgactgatgctacagtgcctcgccgcctgggccccaaaagagctagcagaatccgcaaacttttcaatctctct

SEQ ID NO: 1757 - DNA, 601 bp, Homo sapiens
tcggcacgaggggtgacacaggacgagcctattcaacaacactacaacaagcagccattcccttacttcctaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctc

SEQ ID NO: 1758 - DNA, 530 bp, Homo sapiens
ttcggcacgaggcggcacgaggcggcgcgcacctgtgcggcggcgtcctggtggcggagcagtgggcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcct

SEQ ID NO: 1759 - DNA, 446 bp, Homo sapiens
  misc_feature 92: n = A,T,C or G
tttttgatttccatgcactttaatgaggtccagcactcaggaggattagcgcccaccaccagctgcctgggcaggggagggccggagcagtntgcaggcgtcaggcttaggacagggaagggggctcaggatggggaagggtcctcaggacaggggaaggggctcagaagagagcagggggcttaggacaggaaggggcactcaggacggggcagggaaggtgtggggggcagtcgcacctgggtaggaagcagtggtgttttggacagcaggggttggtcctccagtgacccaggtggccaacccaggcctgactcacggctttttggggacatagtggtggatccagtccaagtagtaggtgacacgggtgtagatgccaggccggttgggctgggcacacttacgccccagctgaccacgcccgcctgcagccaggtgccatt

SEQ ID NO: 1760 - DNA, 495 bp, Homo sapiens
ttttaaacagatgcatttaatgggaaatcttaaggcaggggtggcaggagctgcgggctcagttggcggccaggatcttctgcacccagggtatgagcttggcgacacgggcgtacacagcgggcgtggtggtagagcaggtgcggctgccccaggacacaatgcccaccagggtccaggctccgtccttctggcagaccagggggcctccagagtcacccatgcaggaggagacgccactggccccggcacagatcatcacgtcggtgatcctcctgccccaggacttcttgcattcggcattggacaggaggggcagggctgcctgctgcagcttgtcaggggtcttgttggcgttgtacttggtcttgccccagcctgtggtggcacacagtgtccccgcgggaagtcgtcgtcggcgctgggcaggcacacggcggacactgtctgggagaagcgggcaggtgtggccagcttcagcagggtgatgtcatt

SEQ ID NO: 1761 - DNA, 600 bp, Homo sapiens
ttttaatataaattatagctttattttttaaaaagattttataagtctgtcacaacctcaaacacatataggtgaattatttattcctctcttccatcagatgaggcttatcgtgtcaaatcctctgaaaaatataagtaaaaattatttttcacaaatatatatcccctatattactcaacttagttctgaaattttctccttataaatactttaacacagctgctagtggaaggactgtgttgtgcagctgcacatagctataattttataagtctgctttacttttgctagctccctggttcagctccaaggtccaaatcttataaatggttaactgggctgccagaaaagcccactgaatgcatcctgtagtgctctgtgacaagcaagagaagaagtatagcctccagcaaggtcctgtggtgaggcagctctgacatggtttaaatacccaagtcttcctagcatctcaagctcaggaacatgtggtccatatgtctctatctgcagtggctggtattcatacagagcttcttcaagcttgtgaataggtgccagtgaaatatgttgacccattttgatgcctgtggaaaacgt

SEQ ID NO: 1762 - DNA, 467 bp, Homo sapiens
tcggcacgaggcgcagtactatggccaacaggccggggtactccacgaggctcgagtccccataatcaacaatgatgtctgcaatggcgctgacttctatggaaaccaaatcaagcccaagatgttctgtgctggctaccccgagggtggcattgatgcctgccagggcgacagcggtggtccctttgtgtgtgatgacaccatctctcggacgccacgttggcggctgtgtggcattgtgagttggggcactggctgtgccctggcccagaagccatgcgtctacaccaaagtcagtgacttccgggagtggatcttccaggccataaagactcactccgaagccagcggcatggtgacccagctctgaccggtggcttctcgctgcgcagcctccatggcccgatgtgatcccggtggtgggatccacgctgggccgaggatgggacgtttttcttcttgggccc

SEQ ID NO: 1763 - DNA, 369 bp, Homo sapiens
ttttctgcatcagtaattttaatagagactcttagtggttatcaacaactggtcagttgttttttgtttttttttttccacactgctctctggattcgaacctagtgaattctgggctcagtcctcctcctccatctctttcttgatccagtccacgtagttgagcactttggtgtagaagccatagcccctgctgcacccgatgccccaggacacgatgcccgtggccacccagcgatcagtgttcgggtcccttactgcaaaaacgcccccactatccccctggcaggcgtcctgctttagagatgggtgtccagcacagaacatgttttgagagaacacatccatcctattctttccccggagcca

SEQ ID NO: 1764 - DNA, 462 bp, Homo sapiens
tcggcacgaggttttttttttctctgcaaggggcaattattcctggataaggcaagataattgtggtcacaaaaaaagcagccaaatgcaaatctgttgagctaacagggggagtgtctcattcagtctttcccagctttgcaatcagctcatcacaaatttttgtcagttcttcaatttcttggttcttctgctgcagggccctttccagggactccaccttcatctgctctttgcggagtccagcatggaaagctgcactctcaccctttgcttttgttcaaacctgaccaatctcttcattggctttgtccagtttctcttctgcgtggattttcagggcctggtatcgctgctcctcttgtttaactctggctaagtaatcctgagcacatttcttcaaggcttcttcattcttcttgaacccttccagaacacctttcaggttctcatatctcctga

SEQ ID NO: 1765 - DNA, 412 bp, Homo sapiens
  misc_feature 10, 11, 346, 384, 393: n = A,T,C or G
agaaacaacnnttttgtttgatttggggaggagagaaggggtgcagatgggaaatggggaggcaagggctctttagcgtttgccaaaaccactgccacacccctccaccccctcttgccttcctcctccacggtgggtgccagcaggctctcccctttccagtgacctccctctccctcctcccagcaccccacttgggcttcaacctccagtgactgcacagagcccacccagggtctaaagctaggggaaggcagctcaaactcacctttcttctcccttcttccacctcccacctcattcccatctcttgtctaaataaaatacaggaaaagcaagcgcagtnggttaactgggggagaattgggatttaaaccccggggnttggggggnaaggggttgggggaattgg

SEQ ID NO: 1766 - DNA, 482 bp, Homo sapiens
tcggcacgaggagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctc

SEQ ID NO: 1767 - DNA, 500 bp, Homo sapiens
  misc_feature 349: n = A,T,C or G
ggtgtacgcggtggaggccattgagatggcacagcacacggggcagctggtcctgcagaacggctttgctgacatcatcaccgtgtaccatcagaatgtggaggatgtggtgctgcccgacaagtggacgtgctggtgtctgaatggatggggacctgcctgctgtttgagttcatgatcgagtccatcctgtatgcccgggatgcctggctgaaggaggacggggtcatttggcccaccatggctgcgttgcaccttgtgccctgcagtgctgataacgattatcgtagcaaggtgctcttctgggacaacgcgtacgagttcaacctcagcgctctgaaatctttancagttaaggagtttttttcaaagcccaagtataaccacattttgaaaccaaaagactgtctctctgaaccgtgcactatattgcagttggacatgagaaccgtgcaaatttctgatctacataccctgaagggcgagctgcgcttcgacat

SEQ ID NO: 1768 - DNA, 405 bp, Homo sapiens
tcggcacgagggggattcaaacttcaacaaaatgtggcaaccagaatggggaatgcatcagcaacccccacacccccctccagatcagccatggatgccaccaacaccaggcccaatggacattgttcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaaaaaaaaaaaaaaaaattttt

SEQ ID NO: 1769 - DNA, 424 bp, Homo sapiens
tcggcacgagggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatc

SEQ ID NO: 1770 - DNA, 484 bp, Homo sapiens
acgaatctcagcaaaaactacaactatgatattcatgccaaaataaaatctgtgcaatagagtggctgcaatgaggtcacaacggtggtggatgtaaaagaaatcttcaagtcctcatcacccatccctcaaactcaagtcccgctcattacaaattcttcttgccagtgtccacacatcctgccccatcaagatgttctcatcatgtgttacgagtggcgttcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaact

SEQ ID NO: 1771 - DNA, 547 bp, Homo sapiens
tcggcacgagggccgcagggagtctgagcaaggggtgtacacctgcacagcacagggcatttggaagaatgaacagaagggagagaagattcctcggtgcttgccagtgtgtgggaagcccgtgaaccccgtggaacagaggcagcgcataatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttc

SEQ ID NO: 1772 - DNA, 475 bp, Homo sapiens
tcggcacgaggcagtctttggggctgtcctgcacccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttccc

SEQ ID NO: 1773 - DNA, 408 bp, Homo sapiens
cctggatgcggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttga

SEQ ID NO: 1774 - DNA, 501 bp, Homo sapiens
attcggcacgaggcttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagc

SEQ ID NO: 1775 - DNA, 603 bp, Homo sapiens
  misc_feature 345: n = A,T,C or G
tcggcacgaggggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccanggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcaaaaaaaaaaaaaaaaaaaaaaaaaaaaaaccggg

SEQ ID NO: 1776 - DNA, 500 bp, Homo sapiens
  misc_feature 317, 318: n = A,T,C or G
gcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcctcggcctgaggttacccggcccggcccttcctcgcttccctcgactattccactgcgtctccgcgccccgggtcatcctgcgagtccctctgacgggagggaagatggctgcacggagctggcaggacgagctggcccagcaggctgaggagggctcggcgtcnntgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggcgccggcttgcgcggcgcccgcaaaaagc

SEQ ID NO: 1777 - DNA, 253 bp, Homo sapiens
ggccgcgcagcgctgggggcgccacgcaacgcaggtcgcggtagggacgcacgcgtggggggcgtgccgttcagccaggcgcgcagcggcacaaggcggcagtcgcagcgccaggggttggcgcccaggtgtgcggtgcgcagcgcgggcagcgcgtccagcagccccggcggcagcgccgtcaggttgttgccggtcagcaccagctcggttgtgtcgacagggaaggcggtcggcagtgaggcccaagtca

SEQ ID NO: 1778 - DNA, 406 bp, Homo sapiens
tttttggattaaatattcttattattccatttttttctttataaactattatgttatgcatccttttactatttacttttattttgctattacctttacttttactactattagtgattaccctagaaattataacttgcatccctgatttatcaaggcctaatataaattagtacttataccatttcctgggcaattcaaggaccttaagcttcacttcttccatccacctataccagctgcttgtgctttgttggtgtatatttcaattctatattctaaatcccagaggacattattattgcatacaattaacattcagttaagtttacccacactttattctttccactgctcctcattcctcttagaatctctgtatttccttctgcagtcattctcctct

SEQ ID NO: 1779 - DNA, 544 bp, Homo sapiens
  misc_feature 325: n = A,T,C or G
tcggcacgaggaggaagtccaggagttttacaaggacaccgtacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcangaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttg

SEQ ID NO: 1780 - DNA, 369 bp, Homo sapiens
tcggcacgaggtttttttttttttttaattaagaaaattaaatcttttaatataaaagggaatttcaaaaactttccaaatgggccccccatatttaaagccagccccttttaaaccctaaatacctttaaaaaattttttttattgaaggaccaaatcaaatgggctcaaaaaaatcaaatgggggggatccccaaataaaatccttgttaaggctaaccacatggaatacaaattttttttatcctaaaaactttaaaaggcccatgggtaaatttctttgggagggggaaaaatagttggcccaaaaaaacccttttcacagttaaaggaacttgaaagttctgccccagggagccctaagggttt

SEQ ID NO: 1781 - DNA, 504 bp, Homo sapiens
  misc_feature 432: n = A,T,C or G
ggtctttttgtcttttttttttttttccttttaatacctgaatgttctgcgaaaactgaaattgttacaggcatctgaaccacgggaggaggagttgatggcgatcgtggtttaggctctgatggccccaatgattctggacctccttcccccaattttgatgattcagggtatattatctcctgtaattgactgtagtcaacattttgcgttgactgagccattacagactctgctacatatttacaatgtgaactttccgttccttgctgggattctgtccctgcctcttcttcacaatctgttacacagcttttaggggcatcagaaactgaaacaatatcttctcctgtttgaaatggttctaaagttgctttaataatggcccaatcattccatactgtaagtgggatgattttaccttccctattngcttgttttaattctttgccaattttttccaatcttttagatctaaagttccctgttctgaaaacatgggca

SEQ ID NO: 1782 - DNA, 678 bp, Homo sapiens
aatgaaaagaaacatttatttacactttgtacatatcgattccaacaaacaataaaaggcctacacatcagtataatcataatatatgcgaacttccgatcttctcacactttgcagtgatctgatgctttcactcctggttctgatatttgattttttgaacagccttcttgaaaatgacctacacatgaaaaagtaaattattggatccaggcaaacattacacgcagacaagaaaagtgtaatttctttgcagtaatataggattttttgtgcagattcatctaaaagcctgtctaagtgactaaaagtaaaaggaattctgcacaagtgatatggtagaaagcaggtaaaaaacacagccacaacaaccctgatgctctggttatgttttcgctttcggcttgactgacttatgaattgcctgctggatttgtggatgtacctggatatggctatgtaacatccgatcagaatcaccagcacggccacaaacaagcagctgttcacataggtgactgccgtatgccatttgacccccaaaggactgttaagttttgagcagtcatggatattgtgctctgttggctgaccatatgtcatgatgatgtctggcaaagatcaaacagtcatgatcaccccaacacaaacagataaaaccttcgtgaatgttatgct

SEQ ID NO: 1783 - DNA, 499 bp, Homo sapiens
ttcggcacgagggagagaattccagcagggaagaagtacacatttccacgaatggtttgggaattcaagcatcatatggctgaggtttgaactacagctcatgccaataacatgtgcacatgcgccagcattccagcgtccaacagagcatgcgtgcaccattccagcatccggcaacaatgcaccagcattccagcgtccaacagagcatccgtgtaccattccggcatttggcaacaatgcaccagcattccagagtccaacagggcatgcgtgcaccattccagcatccggcaacaatgcaccagcattccagcgtccaacagagcatccgtgtaccattccggcatttggcaacaatgcaccagcattccagagtccaacagggcatgcgtgcaccattccagcatccggcaacaatgcaccagcattccagcgtccaacagagcgtgcgtgcaccattccagcatccggcaacaatgcaccagcattccagcgt

SEQ ID NO: 1784 - DNA, 387 bp, Homo sapiens
gcctactactactatacggctgcgagaagacgacagaagggagttagtggatataattaagggtctcaattagttgactttaggctgggtttatcctgcttggactgtcctaatcaggtgagaccttgaaaggactgggttcttcctgagcatagagactcacagtgtgagagggactcagcatgagggggttcctccagcatgggctttgaaaatgaaagggctgtgggccgggtgcggtgcctcacgcctgtaatcccagcactttgggaggctgaggcgggcggatcatgaggtcaggagatcgagaccatcctggctaacatggtgaaaccctgtctctactaagaatacaaaaaaaaaaaaaaaaaaaaaaaaagtcgtatc

SEQ ID NO: 1785 - DNA, 149 bp, Homo sapiens
gagaagacgacagaagggacaaagagatctggacagaatcgcccctgatgcggcggcatgccgacaagaagcattagaacaaaccattctgggtaataaatggtctctttgccctgagacaaaaaaaaaaaaaaaaaaaagtcttatcg

SEQ ID NO: 1786 - DNA, 536 bp, Homo sapiens
attcggcacgagtggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaaggacgctgggactcagcagcccatgtgacaacagggttccagcacagcagctgtattttaccaccccttccaaccagaatgtataccaggtggactctctgcaatctacgtgaaagaaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacag

SEQ ID NO: 1787 - DNA, 479 bp, Homo sapiens
  misc_feature 1, 390, 455, 466: n = A,T,C or G
nggaataagaagaagcagcagaaaccagaactcagggatctggtctttagctccccaggggacatcccagctgaagacttcgctgaccacgtcaggaagaatgagagggacagcaactgtggttttgcagacgagtaccagcaactctccctggtgggccacagccagtctcagatggtggcttcggcttcagagaacaacgccaagaaccgctacagaaatgtgctgccctatgactggtcccgggtgcctctgaagcccatccatgaggagccaggctctgactacatcaatgccagcttcatgcccgtgaagtgtgagcattactggcctctggacttcgcagccctgcacccatggggcacctggcgggttaaccctgggtagatnaggaagttgatgggagaactgggacggtgcgggaattgctgcttccttccaggttgaaggacagnaagacactgtnttttgcgccaatt

SEQ ID NO: 1788 - DNA, 318 bp, Homo sapiens
ttttttttttttttttttttttttttttttacaatttcatggcaatttatttaaaaaaggtagagaccatgttttttcttttctttaaatctctgtaccctaccgcttggctcaacattaggctctggatataataaagatttgttgaatgaacaagtacacaagtgaaaaatgcttaaaaacatgttctgctcaattggggtcagattgctgtccaaactcctccagtagaggacaatcgcctcctccttatgggaagatctatataatcacagaacagctggactcaaagaggagcctcagctaaggctaatggtt

SEQ ID NO: 1789 - DNA, 415 bp, Homo sapiens
gtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacat

SEQ ID NO: 1790 - DNA, 557 bp, Homo sapiens
gacagaggggaggccccacgccaccgcctctgcctccaggccgcccgctgctgcggggccaccatgcacctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccgaggtggcagctctcactgcggggaccctgctacttctgacagccatcggggcggcatcctgggccattgtggctgttctcctcaggagtgaccaggagccgctgtacccagtgcaggtcggctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtgga

SEQ ID NO: 1791 - DNA, 493 bp, Homo sapiens
gggagcgaattccagtctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctg

SEQ ID NO: 1792 - DNA, 472 bp, Homo sapiens
tattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccc

SEQ ID NO: 1793 - DNA, 491 bp, Homo sapiens
agtcctgcttatcacaatgaatgttctcctgggcagcgttgtgatctttgccacctttcgtgactttatgcaatgcatcatgctattttcattacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcaaacaaaaaaaaaaaaaaaaa

SEQ ID NO: 1794 - DNA, 137 bp, Homo sapiens
tggcaccatgtgggtcccggctgtcttcctcaccctgtccgtgacgaggattggtgctgcacccctgatgctgtctcggattgtgggaggctgggagtgctaaaacattcccaaccctggcaggtgcttgtggcctc

SEQ ID NO: 1795 - DNA, 827 bp, Homo sapiens
  misc_feature 365, 617: n = A,T,C or G
aggtttgagggggaatgctggagaatgtaatggggtatgaagacattccatataattattccaagggtgagtggtaggaattttttccataggaggtgtatgatttggtcgtaccggaatcgggggtatgctgtccgaattcataagaacagggaggttagaagtagggtcttggtgacaaaatatgttgtgtagagttcaggggagagtgcgtcatatgttgttcctaggaagattgtagtggtgagggtgtttattataataatgtttgtgtattcggctatgaagaatagggcgaaggggcctgcggcgtattcgatgttgaagcctgagactagttcggactccccttcggcaaggtcganaggggttcggttggtctctgctagtgtggagataaatcatattatggccaagggtcatgatggcaggagtaatcagaggtgttcttgtgttgtgataagggtggagaggttaaaggagccacttattagtaatgttgatagtagaatgatggctagggtgacttcatatgagattgtttgggctactgctccgcagtgcgccgatcaggcgtagtttgagtttgatgctcaccctgatcagaggattgagtnaacgcctaggctagaggtgggctagataaataggaggcctaggttgagggtgaaccaggggttgggtattgggaagggggtttctagtagaagagcgatggttgagagctaaagtcggggcgttgatgtaaaggggaatggtaattgtggcggttttaagggccctttggtgaaaagtttaattgccttacgaggggtttgtagtaaccc

SEQ ID NO: 1796 - DNA, 375 bp, Homo sapiens
tcatagctctgtttgtgtctgaggaggagaaaaagctgactcggaaggaggtctacatcaagaatggggataagaaaggcagctgtgagagagatgctcaatatgccccaggctatgacaaagtcaaggacatctcagaagtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctga

SEQ ID NO: 1797 - DNA, 475 bp, Homo sapiens
tggatcccccgggctgcaggcaccgaggagctgcgggtgcgcctcgcctcccacctgcgcaagctgcgtaagcggctcctccgcgatgccgatgacctgcagaagcgcctggcagtgtaccatgccggggcccgcgagggcgccgagcgcgggctcagcgccatccgctagcgcctggggcccctggtggaacatggccgcgtgcgggccgccactgtgggctccctggccggccagccgctacaagagcgggcccatgcctggggcgagcggctgcgcgcgcggatggaggacatgggcagccggacccgcgaccgcctggacgaggtgaacgagcaggtggcggatgtgcgctccaagctggaggagcaggcccagcagatacgcctgcaggccgaggccttccaggcccgcctcaagagctggttcgagcccctggtggaagacatgcagcgccagtgggccgggctggtgg

SEQ ID NO: 1798 - DNA, 266 bp, Homo sapiens
cctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagccccca

SEQ ID NO: 1799 - DNA, 565 bp, Homo sapiens
cggcacgaggcaaaacaccaaatggcggatgacgccggtgcagcgggggggcccggaggccctggtggccctgggatggggaaccgcggtggcttccgcggaggtttcggcagtggcattcggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtccctt

SEQ ID NO: 1800 - DNA, 425 bp, Homo sapiens
cggcacgagtcctccgctcgctgcctctcctccgcttccttctctctgcgtagtgggactcttctttggcagcgccatcgtcatgtacatggcccctaagtcccgccatcctgaggagcagcacaaggtcctttttctattttacagttctttcaacccgatgctaaaccccctgatttacaacctgaggaatgtagacgtcaatggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttctttgcagataaaattttacatgtgttgcattcattgggtttctatg

SEQ ID NO: 1801 - DNA, 551 bp, Homo sapiens
tcggcacgaggatgtctagcagcttcagacatttggttaagaaccccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggaaaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctct

SEQ ID NO: 1802 - DNA, 553 bp, Homo sapiens
  misc_feature 477: n = A,T,C or G
cggcacgaggcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgangtggggtcctggatcggtttcgccatcatgacgcagtgtctcccagtggccctgttctccctggtgggtttcaccc

SEQ ID NO: 1803 - DNA, 569 bp, Homo sapiens
tcggcacgagggtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaaaaaaaaaaaaaaaaaa

SEQ ID NO: 1804 - DNA, 453 bp, Homo sapiens
tcggcacgaggccttgggggaagcctgcccatgtcgggctgtgggaggctgatcagtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcatt

SEQ ID NO: 1805 - DNA, 613 bp, Homo sapiens
ttcggcacgaggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacacaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccatggctcccactgcagcagctcgggggaccccgctgagtacaacctgcgctcgcgcaccgtgctgtgcgggacctgcgggcagcctgccgacaaggcatctgccaacggctcaggatcccaggtgggcggacccatctcctctggctcttctgcctccagtgtcacggtcactcgcatctaccgcattgtggggggcagtgggggtggcagcttcggggacaatctggtcacccgctccta

SEQ ID NO: 1806 - DNA, 347 bp, Homo sapiens
  misc_feature 93, 300: n = A,T,C or G
tcggcacgaggaatctgaagtgggagcatccccctcctctccctgttagaatgttagtgccccgcactgtgccccaagttctaggccccccanaaagctgtcagagccggccgccttctcccctctcccagggatgctctttgtaaatatcggatgggtgtgggagtgaggggttacctccctcgccccaaggttccagaaggccctagcgggatgggctcgctgaacctcgaggaactccaggacgaggaggacatgggacttgcgtggacagtcagggttcacttgggctctctctanctccccaattctgcctgcctcctccctcccagctgcactttaaccct

SEQ ID NO: 1807 - DNA, 518 bp, Homo sapiens
agccaccacaggcacattcaccggtggcgcgtcctggtgggcctccgggtgccgacaccaggcatcagccgcccctccctcccgccacagtaggtctgtgcggcctgtccggccccgctgctgtggcgcaggcaattctcccaaacggttccactgggcgcctggggctgggggcggagccagtgaccacgggagggcgggacctcacccggggcccaggacccctgaacacaagtcctccgagctggaggctactccagaaccacggtgccgcccaccgcctccagggccgccttgatcttctccgcctcagctttggcgacattggctttgatttcctggggcagggactccaccagcttctttgcctggacgaggttgatgccttggatgtagttcttgatttccttgatcagcttcactttgtccacgggcttcgcctcggtcaggcggacggtgaaatgtgtccgttctttcgctatggggatatcttcttccaccgcctcctgggctgctgc

SEQ ID NO: 1808 - DNA, 571 bp, Homo sapiens
tcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagcccccctt

SEQ ID NO: 1809 - DNA, 561 bp, Homo sapiens
  misc_feature 433: n = A,T,C or G
tcggcacgaggattatttcagaggtcactgaagactgtgattacatgcacctgccttagaaggtaggattttcttcccaggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttangcgtcacgccaaaggccagcctcctggccccaatacccattttggaagcccctgtggccgtgtggatgtcggtaacagttgtataaaataaattctatttatcgctattaaaaaaaaaaaaaaaaaaa

SEQ ID NO: 1810 - DNA, 572 bp, Homo sapiens
  misc_feature 436: n = A,T,C or G
cttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgataagttctcggaggtgcttaagcggctgcgacttcagaagcgaggcacatgcggtgtggacacggctgcggtgggcggggtcttcgacgtctccaacgctgaccgcctgggcttctcaaaggtggagctggtgcaaatggtggtggacggagtgaagctgctcatcgagatggaacagcggctggagcanggccaggccatcgacgacctcatgcctgcccagaaatgaatcccggcccacacccgacaccagccctgctgcttcctaacttattgcctgggcagtgcccaccatgcacccctgatgttcgccgtctggcgagccc

SEQ ID NO: 1811 - DNA, 530 bp, Homo sapiens
  misc_feature 134, 420: n = A,T,C or G
tcggcacgaggattaccactcaggcatttgactgaagatgcagctcactaccctattctctctttacgcttagttatcagctttttaaagtgggttattctggagtttttgtttggagagcacacctatcttantggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcanagatgtgcacccatgggctctgacagaaagcagatacctcaccctgctacacatacaggatttgaactcagatctgtctgataggaatgtgaaagcacggactcttactg

SEQ ID NO: 1812 - DNA, 470 bp, Homo sapiens
  misc_feature 248, 261, 448: n = A,T,C or G
ttttttaaagtgacccagttttattttggttttggaggccagacagggcattgctccacgggttcgggctgtacaaccttcccctccttgaggtgggaggcccagcaaccacagggcccaggcagcggggtgggaggctcaggaaatggtggctctggggacccgatcccgaggagagagggggcagcaggcaaaggcctgcaatggctcaaattgggggaagagggcggcgagggggagaggacacnatccaagaaccanagtccgaaagctgaagctggtccggtctctttcactttacggccgaggctggggtcagagaagtgaagccaaactgtcctcccgcaggaggcaaggcctggagggacgccagggtcccagtccggtgccgggccctgcgcacacagccgccgcctccaccctcgcggagggcgcgcgcggggcccantcgctgggtgcagggtccggcg

SEQ ID NO: 1813 - DNA, 585 bp, Homo sapiens
tcggcacgaggcggcaacactagagaaggcaccttgcagatattttcaatacaaatgccatcaactctgacacagtcaaacgcttagttcattttgttctggcaaaatttaccacatctttggccaaagaggggggaacaagcaagagggagtcacatctgagcacagcagctcatcccacaagctacaagctgctcagaggctcgaagcccccaggggcctcccttctcccctcacttggattctcccagcccgcgtccttcctccccctctcacatccgccatcctttcctctcgccggccccctgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccacccacggatgttgtcaggaatcatgatctgacttt

SEQ ID NO: 1814 - DNA, 289 bp, Homo sapiens
gagaagacgacagaagggtctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgcattttcaccgagcttatatttggtgtgttttttgtcttttctttatgattatcaataaaatgcaaaaaaaaaaaaaaaaaaaaaaaagt

SEQ ID NO: 1815 - DNA, 443 bp, Homo sapiens
gcttcactttttccgttgctagcagtggaagggtcacagaccaaacactaaggcctgagcggtgacaatcgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggggagcgtcaacaagctgtacc

SEQ ID NO: 1816 - DNA, 515 bp, Homo sapiens
gagtggtgtgtgagagtcaggcgtccctctgcctgcccactcagtggcaacacccgggagctgttttgtcctttgtggagcctcagcagttccctctttcagaactcactgccaagagccctgtacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatca

SEQ ID NO: 1817 - DNA, 485 bp, Homo sapiens
ggtacctgtctataaggagtcctgcttatcacaatgaatgttctcctgggcagcgttgtgatctttgccaccttcgtgactttatgcaatgcatcatactatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcg

SEQ ID NO: 1818 - DNA, 618 bp, Homo sapiens
ttcggcacgagctcgtgccgcgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttg

SEQ ID NO: 1819 - DNA, 69 bp, Homo sapiens
gcttctatccagcagaagtgactatcacgtggaggaagaacgggaagcttgtcatgcctcacagcagtg

SEQ ID NO: 1820 - DNA, 399 bp, Homo sapiens
gatagttctccctgagtgagacttgcctgcttctctggcccctggtcctgtcctgttctccagcatggtgtgtctgaagctccctggaggctcctgcatgacagcgctgacagtgacactgatggtgctgagctccccactggctttggctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaagacttcctggaagacaggcgcgccgcggtggacacctactgcagacacaacta

SEQ ID NO: 1821 - DNA, 495 bp, Homo sapiens
  misc_feature 414: n = A,T,C or G
tcggcacgagggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccanggctcctgtggctcctgctgggccttcggggctgtggaagccatctctgaccggatctgcatccacaccaatgcgcacgtc

SEQ ID NO: 1822 - DNA, 582 bp, Homo sapiens
ccgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagagagcctgcggatcgcgctccgctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctc

SEQ ID NO: 1823 - DNA, 57 bp, Homo sapiens
tcgcgcgcctgcaggtcgacactagtggatccaaagaattcggcacgagctctttct

SEQ ID NO: 1824 - DNA, 645 bp, Homo sapiens
  misc_feature 512: n = A,T,C or G
tcggcacgaggaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcangacttcatgatgtatagaacgggcatctactccagtacttcctgccataaaactccagataaagtaaaccatgcagtactggctgttgggtatggagaaaaaatgggatcccttactggatcgtgaaaaactc

SEQ ID NO: 1825 - DNA, 635 bp, Homo sapiens
ttcggcacgaggagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagaaaagtcgtttcattcaagttggtgtaatcagctggggagtagtggatgtctgc

SEQ ID NO: 1826 - DNA, 327 bp, Homo sapiens
  misc_feature 53, 60, 86, 106, 138, 141, 143, 177, 198, 210, 228, 230,258, 272, 280, 288, 304, 319: n = A,T,C or G
ttttttttggagtttcaacgtttattgaggtcacggtggggtgaggtgcaggncggcctntctcccggagccccgtggagggagtntggggggacgggtggggccntccggacgccacagttttcggggaagagctgnttntntccaaagatccgcctcgagggtttggagccaggntcggggtcccggccagcgttntgggaggggcgnttcaggggcggcccttgntnccacacggcgcagtggaaacggatccantccacgtagagggntacccgcntgaagaantcagggaaaaggcggntggcacatccccagntcacgaag

SEQ ID NO: 1827 - DNA, 442 bp, Homo sapiens
cctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttccttctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactc

SEQ ID NO: 1828 - DNA, 394 bp, Homo sapiens
caggagaggatgacttcattgctggggacttggaagcttgggggaccctgaccttcaggcccgggaaccctaggccaggacgctggcaatccaggccgaatagctcgccacgcgggtgtagatcccgggcttgttgcggttgccgcaaacgcgcgagcccgaggcgaccacgccctggagcacgcccccgcacaccagcgggcccacggaggcaccctggcagctgacccggggattgctgtccgcgcacatcaagcgctcggggatggcgccgcccaggtgcgtgctccgagagcaggtggtgcggaccagcactgacaagagcacgtgctgcaagcatgccggacggcggcccgcgtgtatgactatgccccaggcggacacgtggcaaaga

SEQ ID NO: 1829 - DNA, 493 bp, Homo sapiens
ttcggcacgagggggtggggggccaccgaggagaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttaaagatgattcagaggtcacttcatttttattaaacagtgaacttgtaaaaaaaaaaaaaaaaaaaaa

SEQ ID NO: 1830 - DNA, 433 bp, Homo sapiens
gaaccccacttcggcaaacgagtcggtctggatcatctacagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccacacgaagcagatcaggttcatcaagcaaaggcagaggcccttctcctgaatgaagcagcagtaccgagtcctctcctgaacatccgcccaaatccataactgctcgcataggttccaggtcatcaccagagcccaagaccaagtctcgtacaccacctcgacgtcgcagctctcgatcatctccggagctaacaaggaaggccagactgtcccgtagaagccgctctgcctcatcctcacc

SEQ ID NO: 1831 - DNA, 454 bp, Homo sapiens
  misc_feature 12, 13, 17, 19, 214, 370: n = A,T,C or G
acctgcagagcnnggantnatgcagccctcgcagaatgaatgccggcacttctccaatgtcttggcattctggatctcccccagacagatggggcaggtgctctcctgctcttctgcctcctcccgaagcgaggaggaagaggtgggggcagggggggaggaggaggggggagccccgaggctcctgggggcagaagtggggctgctcggaganggggtgggcctgcgcggtgcatctcagggtgctcccctccaccccccagagccaggcagcccatcagctccccctgcctctgagctttcttcagctctttctctgcctcttttagcagccccttgagagccttccgggctaggtagagcccatttngaggggccgggggaggaccctgtgggaaagcttgagaacatagatgtcagaagtttcgccatctatgaggattggacacacggt

SEQ ID NO: 1832 - DNA, 633 bp, Homo sapiens
  misc_feature 107, 197: n = A,T,C or G
ttcggcacgaggtccgcgggtaccggcaggacgcctacgacggcaaggattacatcgccctgaacgaggacctgcgctcttggaccgcggcggacatggcggctcanatcacactgacctggcagcgggatggggaggaccagacccaggacacggagctcgtggagaccaggcctgcaggggatggaaccttccanaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgt

SEQ ID NO: 1833 - DNA, 519 bp, Homo sapiens
  misc_feature 135, 224: n = A,T,C or G
ttcggcacgagggaaatagtctggcagcctctacagcagaagaaacggcaggcagtgcccagggtcgtgcccaggaggctgagcagctgctacgcggtcctctgggtgatcagtaccagacggtgaaggccctanctgagcgcaaggcccaaggtgtgctggctgcacaggcaagggcagaacaactgcgggatgaggctcgggacctgttgcaagccgctcangacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctaacactgccccacatgcatgtctgcctatgcactgaagagctcttggcccggcagggcccccaataaaccagtgtgaacccccaaaaaaaaaaaaaaaaaaaaaaaaa

SEQ ID NO: 1834 - DNA, 531 bp, Homo sapiens
gtgcaggccatttacaaaatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttaacttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtct

SEQ ID NO: 1835 - DNA, 375 bp, Homo sapiens
  misc_feature 309, 359, 368: n = A,T,C or G
ctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttaggacaacaataagatcaggcaacatccctgatgagtatttcaaggcgtttttaatggcatttgcaggtatctgcggtttatcttcaccacgggacngggcttaaggtggggatcccgggggggaattcttttccaagtggttcatncccgggggnttaggcc

SEQ ID NO: 1836 - DNA, 503 bp, Homo sapiens
attcggcacgaggaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccagaaaaaaaaaaaaaaaaaaggggggc

SEQ ID NO: 1837 - DNA, 372 bp, Homo sapiens
ttcggcacgaggcctcgtgccgtgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgc

SEQ ID NO: 1838 - DNA, 525 bp, Homo sapiens
attcggcacgagggtggtccaggagccaggtgactacgaagtctcattcaagttcaacgcaggaacacatctcccgacagccccttcgtggtgcctgtggcttctccgtctggcgacgcccgccgcctcactgtttctagccttcgggagtcagggctaaaggtcaaccagccagcctcttttgcagtcagcctgaacggggccaagggggcgatcgatgccaaggtgcacagcccctcacgagccctggaggattgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcatgtctggaaggcggtgtcacagggaacccagctgagttcgtcgtgaacacgaacaatgcgggagctggtgccctgtcggtgaccattgac

SEQ ID NO: 1839 - DNA, 636 bp, Homo sapiens
attcggcacgagggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggaggagatggcccgccatctgcgcgagtaccaggacctgctcaacgtgaagatggccctggatgtggagattgccacctatcggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagccctcccctccctgctgcagggctc

SEQ ID NO: 1840 - DNA, 451 bp, Homo sapiens
acatgttcataccaactttattcatgatagccccaaactagaaacagcccattgttcaccagttagttgttcacctaacaggtgaaacgttaaaatgtggcattcatacatagaacactgctcagccataaaaaggaacaaagcttaaacacactgatgaacatacaaacatgctgagtaaaaggaacttacagaatacatactgcataagtgagtccgttatatgaagttctagaataggcaaaattaatctacagtgaacaaaatcctaacagtagctgactgccaggggagggaagaagggacaggagagagaggtgcaggaattgactaggtgaaaaaattcagatgtaatacagatgttccagacataggggtttgagttacatgcttttacatcaaaactcatcaaatgagtctgggtatggtggctcacacctgtaatcccagc

SEQ ID NO: 1841 - DNA, 359 bp, Homo sapiens
gtcaatgggctgctggacctggtgaaggcccgggctgtggagacctgcgtgccgggaagccagcctgtgccctgtgtcccctggtgggtggcaccagcaccggggggccggccaccggatagcctaggaacagtgccgatgacttgtgccaggcctgtgccgacgggcacgctgcacccgccagacccacacccaccgcgtcgtggacctggtgggctacagggccgggtggtatgatgaggaggcccgggagcgccaagcgcaccagtgtccccagcaccccggggaggcactgcgcttcctgtgccagccctgctcacagttgctgtgcagagagtgccgcctagacccccatctgg

SEQ ID NO: 1842 - DNA, 568 bp, Homo sapiens
  misc_feature 431: n = A,T,C or G
tcggcacgagggtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggangaagtgttcatttacacacctctcttgagctacctgcgtctttatgacaacccctggcactgtacttgtgagatagaaacgcttatttcaatgttgcagattcccaggaaccggaatttggggaactacgccaagtg

SEQ ID NO: 1843 - DNA, 485 bp, Homo sapiens
  misc_feature 144, 443: n = A,T,C or G
gggccgcggagcccaccccgcccacgtcgccggagccgccgcgcacgagccccaggcagacccccgcgcccggccccgcccggagaaagagcgccggcaagaggggcccggaccgcggcaccccgagtaccggcagcggcgcancgcaacaacatcgccgtgccaagagccgcgacaaggccaagcgggcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggacctgccctgccctggcgcacgangaccgccgggtgccgctgcagtttcttgggacataggagcgc

SEQ ID NO: 1844 - DNA, 517 bp, Homo sapiens
  misc_feature 214, 328: n = A,T,C or G
ttcggcacgagggtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccangcagcccctaccgcgttgtggtgccctgagtctggggcccgtgccagccggcagcccccaagcctgccccgctacccaagcagccccgccctcttcccctcaaccccggcccangccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccact

SEQ ID NO: 1845 - DNA, 389 bp, Homo sapiens
gcggtcgcctactactactatacggctgcgagaagacgacagaagggagttagtggatataattaagggtctcaattagttgactttaggctgggtttatcctgcttggactgtcctaatcaggtgagaccttgaaaggactgggttcttcctgagcatagagactcacagtgtgagagggactcagcatgaggggtttcctccagcatgggctttgaaaatgaaagggctgtgggccgggtgcggtgcctcacgcctgtaatcccagcactttgggaggctgaggcgggcggatcatgaggtcaggagatcgagaccatcctggctaacatggtgaaaccctgtctctactaagaatacagaaaaaaaaaaaaaaaaagtcgtatcga

SEQ ID NO: 1846 - DNA, 125 bp, Homo sapiens; identical to SEQ ID NO: 1051

SEQ ID NO: 1847 - DNA, 609 bp, Homo sapiens
ttcggcacgaggcggagcggcacctacgtcctgatcgactggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgt

SEQ ID NO: 1848 - DNA, 159 bp, Homo sapiens
ccggtgggaaaagaccaccgaagggaccaagagatctggaccgaatcgcccgaccgggggcagctggccaccagaagcatttaaaccaaccatgcttggttaattaattggcttattcctgaacaaaaaaaaaaaaaaaaaaaaaaaaagtcgtatcga

SEQ ID NO: 1849 - DNA, 459 bp, Homo sapiens
gtctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagt

SEQ ID NO: 1850 - DNA, 510 bp, Homo sapiens
acagaggggcttcactttttccgttgctagcagtggaagggtcacagaccaaacactaaggcctgagcggtgacaatcgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggggagcgtcaacaagctgtaccaggacgaaaaggcggttttggtgaataacatcaccacaggtgagaggctcatccgagtg

SEQ ID NO: 1851 - DNA, 564 bp, Homo sapiens
gcgccatggtgaagtgacgttcaactccgctctggcccagaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatc

SEQ ID NO: 1852 - DNA, 451 bp, Homo sapiens
  misc_feature 412: n = A,T,C or G
acagaaggggatagttctccctgagtgagacttgcctgcttctctggcccctggtcctgtcctgttctccagcatggtgtgtctgaagctccctggaggctcctgcatgacagcgctgacagtgacactgatggtgctgagctccccactggctttggctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacttcctggaagacaggcgcgccgcggtggacacctactgcagacacaactacggngttggtgagagcttcacagtgcagcggcgagtccaacct

SEQ ID NO: 1853 - DNA, 104 bp, Homo sapiens
ggtctcccgcccggcgcccccagtgttttctgagggcggaaatggccaattcgggcctgcagttgctgggcttctccatggccctgctgggctgggtgggtctg

SEQ ID NO: 1854 - DNA, 396 bp, Homo sapiens
tttcagatcacgacaacaggtaacctttagtcagaactcaccacccactgtgttaagccttacatgacaatcaccatgaagatttacatacacatgttatatcatagtctcctcacaacatgtctaagaggtaggcacgtcattgttcccattttgcagatgaggaaactgaggttcagagagggcacttggcttgcccaaagtcacacagcagggagtggcagaggaagtcaggttgggtgaccccagtaactgctctcagaggctgggtgatgaccggcttcctggcttctctggaataaacctttgccaccacttcctgcatttcagcttcagtacaggcagagaatggggataggtgggggaatgaggtgagaggggagatgtttagaggtg

SEQ ID NO: 1855 - DNA, 442 bp, Homo sapiens
tcggcacgaggtgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttc

SEQ ID NO: 1856 - DNA, 544 bp, Homo sapiens
aatccactttatttatccatccccccccaacattagcaaaattaaacccaaggaggaggaggggggtgaggtaaaaaatgacctggaggaccccaaaaggggtaggccccctgggaaaaaagggtcaaaggccaaaggatgggagggggtcaggctgaaactgaggagcaggtgggggcacttcccccccaaaaacccccccctgttgaagctttttgtgaggggggagcccaggccctgaggggggacttcccaggggaaaacttttgtgtttctcgaattctgctttccccaccccaagggggctgctaaggctgaaggtgctgtccttgctgtcctgctctgtaaacacccccggggatttacccgattggagggggttatccacctccatggtactttgggcctccggggataaaagttattcagcaggaacacaacaggggggagttccaatttcatctgctcatcagatggcggaaaaatgaaaaacaatgggccacccacagttcgtttgatctcctaacttggcccccggccaaag

SEQ ID NO: 1857 - DNA, 464 bp, Homo sapiens
atttatctgtagagatcaagtcgcgctacgtggcccatgctgatctcgaactcctgagatccaatgatcctcccacctcggcctccccttctgcatatagtaggtgctcaataaagaccaaccagatgcaggagtggatgacttcattgctcgggactttgttgcttgggtgaccctgaccttcaggccccggcaccctaggccaggacgctgtcgatccaggccgcatagctcgccacgcgggtgtagatcccgggcttcttgcggttgccgaaacgcgcgaccctgaggtgaccacgccctcgagcacgcccccgcacaccagcgggcccccggagtcacccttgcagctgtcccggcgattgctctccgcgcacatcaagcgctcggtgatggcgccgtcgtggtgcgtgcgccggttgcaggtggcgcggtccagcactggcaagagcacgtgctgcagg

SEQ ID NO: 1858 - DNA, 266 bp, Homo sapiens
ggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctc

SEQ ID NO: 1859 - DNA, 511 bp, Homo sapiens
gcttgtgtttttccttcagtataaaaccactgtagaaaataacttctcttagaaaaaaaaatacagaagaaaaaaaccaaagggttatttttctttggcttcaagccccctcccatgacgtgcagggcagggggtgggcatgaggtgaggaggacgcaggaagcctccacccccacccctgcctggcagatcccagattacatgatgctgcagttctgggggctctgggttcgggggctggagttgcccaggaggtaggagcgggtgaccagattgtccccgaagctgccacccccactgccccccacactgcggtagtgcgagtgaccgtgacactggaggcagaagagccagaggagatgggtccgcccacctgggctcctgagccgctggcagatgacttgtcggcaggctgcgcgcaggtcccgcacagcacggtgcgcgagcaggtgtgtactcagcggggtcaccgagctgctgcagtgggagccatggtggtgatggagcaggt

SEQ ID NO: 1860 - DNA, 387 bp, Homo sapiens
attttatgggccccggagaaaggaaggcaaactctgccccccgctcagagtccccccaacccccacggtttcccgttgccattgagggggaggttcacgaactcaggggaggccagaaaggctctgagcttgggccgggcactgaggcgccccacatatgctgagaccagggggaacgcatccaggaagccaggggctgggaccccatggatcagcagcaatcccaccaggttttagtccgcgaaggaaatctgggcccccaaaatgaaggtcttgccccccgggttttggaaaaaaagggtcccaaaagggttaagttgcccgggaagtgccttaaaaaagcaacccttgcccccccaaaatggggaaagataagggaggtgattt

SEQ ID NO: 1861 - DNA, 552 bp, Homo sapiens
tcggcacgagggcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaagcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctct

SEQ ID NO: 1862 - DNA, 605 bp, Homo sapiens
  misc_feature 325, 474, 545: n = A,T,C or G
tcggcacgaggcaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttaaggacccagacccctaaattctcctcctcccccattttgatgttaaggtggagagggcatatgcatcctctgtcctgatctangtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttangactctgaagggtatggacctacgtgaatgtgtgtcagggggagacttgctggtgggttagtggtcctcangatgtgatagaaacatccagtgtaaaaaggaagttggaatgggagttggcgggcagtgaa

SEQ ID NO: 1863 - DNA, 361 bp, Homo sapiens
  misc_feature 54, 88, 331: n = A,T,C or G
cgcccgcaacacgcccctgctggaccactcggcgcccttcgtggcccgtgcccngcgcatccgcagcagcctggcagtgctgcacttngagaacgccagcctgtcggggcggcccctcatgctgctcgccacggccctgaagatgaacatgaacctgcgggactggtacctggcggacaacaagctcaacggcctgcaggactcggcccagctgggtaacctgctcaagttcaactgctccctgcagatcctggacctccggaacaaccacgtgctagactcgggtctggcctacatctgcgagggcctcaaggagcagaggaaggggctngtgaccctgggtgctgtggaacaaccagct

SEQ ID NO: 1864 - DNA, 498 bp, Homo sapiens
  misc_feature 451: n = A,T,C or G
cccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagaaacgctggcgcaagatccccaagcgccctggctccgtgcaccgcactccctcccgccaatgctgatagtcccctctcctgcatccctccaccccagtccccgggaaaggccggtgggaagagggcaggggctgcatcctcagccccagggccctgctcangcctcacctggcttcccaggaccctgggtcaccttcctgggcagccc

SEQ ID NO: 1865 - DNA, 266 bp, Homo sapiens
cccgcggagaagacgtggaacatctcgttcgcgggctagcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgagcggggccgggggcggcaggcggggggctggcgggaaggccgtgcggggccgggggatggtctccgtgagcggaggggcc

SEQ ID NO: 1866 - DNA, 475 bp, Homo sapiens
  misc_feature 21, 22, 23, 24, 385: n = A,T,C or G
gcgaccgctgctccttccccnnnngcgggggtcgcgctgccagccggggcgggacaggctgctgggacgtcagccccgaggccccgcgccaccccttcctgccccatttctaccgtagctctcaagcacccaaaagatgtcttcgcccttaaccccctgcagcccagcgcccccactccacgggtctctgagggtccccagcaagcagggtcttccctctgggccacccggcatcctctgggagcagcccacttctccccggcgctgcgcagcccctccgaggacaccttctcttccctaggccgcccattgccgcgccccagggagtgtctgcagccacgggtccctccaaccccgcacttgtgtccagcaccagcactttctngggctctcgcccatttcctttgaggatttgcttcttttgacttgctccagaatgttcgtcgggctcatcattttctctgctccctgagtt

SEQ ID NO: 1867 - DNA, 357 bp, Homo sapiens
  misc_feature 195, 231, 289, 294, 333, 341: n = A,T,C or G
ttttttttttttaatggtaccatacatctattaaataatttgaaaaataggcaaacacctttccaacccaatatgcttttatgaagagctgccaagtactagcaacactgatcaacagtgacctcatttatgcatcaaaatcttaagccaagccatcagcacagacagtatgacaacaaattaaaacttaaagantacagtatgtacagttaaaaggatacaattctctgnaattagtttaaatcctaatcacaatgttacaacaaaacctactttgaggctcagttgnagggntgggaaggaacactgggtcttacaaaacacacaaggaancacttaantttaacgggtgttact

SEQ ID NO: 1868 - DNA, 433 bp, Homo sapiens
tcggcacgaggctcacccttgacttggaaaaaccagtttctcttttattgtctgttactaatctctattctaaaaatgcagctcaatgctcaaccatactccaaactctctcttttccagctacctttactccctctccttcaattccactttcctctgcttactttttttttttttcggacggggcctaacttggccgccggggcaggagggcaggggctaaatctggggctcacgggagcctaaacctcccaggttaaagggattttccggcctaagcccctaaagtaggggggactacaagggcacaccaccacgccggacaaatttttggaattttttggaaaagggggggtttcaccagggggcccaaacggggctggaactccggagctaaagcaatccaccggcctgggcctcccaaagggggggg

SEQ ID NO: 1869 - DNA, 652 bp, Homo sapiens
  misc_feature 199, 410, 563: n = A,T,C or G
ttcggcacgaggctcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctangtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctangcagttgctcaagccatgttttatccttttctggagagtagtctaaaccaagccaattgcagaaccacattctttggttcccaggagagccccattcccagcccctggtctcccgtgccgcagttctatattctgcttcaaatcagccttcangtttcccacagcatggcccctgctgacacgagaacccaaagttttcccaaatctaaatcatcaaaacagaatccccaccccaatcccaa

SEQ ID NO: 1870 - DNA, 535 bp, Homo sapiens
  misc_feature 211: n = A,T,C or G
ggcgggaacccactggagaacagtggctttgaacctggagccttcgatggcctgaagctcaactacctgcgcatctcaaaggccaagctgactggcatccccaaagacctccctgagaccctgaatgaactccacctagaccacaacaaaatccaggccatcgaactggaggacctgcttcgctactccaagctgtacaggctgggcctangccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagt

SEQ ID NO: 1871 - DNA, 361 bp, Homo sapiens
  misc_feature 336, 344: n = A,T,C or G
agaaacaactaggttttttgatttggggaggagagaaggggtgcagatgggaaatggggaggcaagggctctttagcgtttgccaaaaccactgccacacccctccaccccctcttgccttcctcctccacggtgggtgccagcaggctctcccctttccagtgacctccctctccctcctcccagcaccccacttgggcttcaacctccagtgactgcacagagcccacccggggtctaaagctaggggaagggcagctcaaactcacctttcttctcccttctttccacctcccacctcattcccatctcttgtctaaataaaatacaggaaangcagcgcntggggtactgggggaga

SEQ ID NO: 1872 - DNA, 674 bp, Homo sapiens
  misc_feature 82: n = A,T,C or G
tcggaacgaggctttgtaagatttctgtgatgctgttttataccaacatgtacggaagcattctgttcttaacctgtattantgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttttatgtaattgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctg

SEQ ID NO: 1873 - DNA, 375 bp, Homo sapiens
  misc_feature 2, 180, 271, 333: n = A,T,C or G
gngcaacttcaactacgtggagttcacccacatcctcaaacatggcgccaaggataaagacgactaggccaccccagccccctgacaccccagcccccgccagtcacccctccccgcacacacccgtccataccagctccctgcccatgaccctcgctcagggatccccctttgagggtntagggtcccagttcccagtggaaggaaacagggccagggagaagtgcgtgccgagctggaggcagatgttcccacagtgaccccagagccnggggttattagtcttttgacccttccaagggaaaggaccactttttgggggacatggggctnggaggggcagggaccttagaaggcaccaaggggaagggcccc

SEQ ID NO: 1874 - DNA, 579 bp, Homo sapiens
aagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggat

SEQ ID NO: 1875 - DNA, 250 bp, Homo sapiens
gcccaaaaaaaagttttattaaattagttgcatgcaggagaaattgggttctccccaggggaagcagagcggggtgtaagggggcaggatccagggcggggaaaggcggggcggatttgggggcctggaggctggggcctggtaactgggggaggtgaagagccccctctgggggggctgaaacccatccttgggggggccctgggactcagagtgcccccgcaagtgtgacaaaagacaaatatccaca

SEQ ID NO: 1876 - DNA, 472 bp, Homo sapiens
ggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcac

SEQ ID NO: 1877 - DNA, 358 bp, Homo sapiens
gaaggagggcgagaaggacgcggcggctgcaaggaggaggccccgaagcggaccgcagaagacggagggcgcggcagaggccaaggctgagcccccgagagcgcccgagcaggagcaggcggcccccggcaccgctgcgggcggcgaggcccccaaatctgctgaggccgccgcggcccgggcgatcagcgcggcgcctgccgcgtgggaggatgccagcaaggaggaaggggaaccaaaaagactgaggcgcccgcagctcctgccgcccaggagaccaaaagtgacgggggcccatcttcagactcaaaacccggcagctcggaggctgcccctcttccaaggagacccccgcagc

SEQ ID NO: 1878 - DNA, 548 bp, Homo sapiens
  misc_feature 415, 441, 467: n = A,T,C or G
tcggcacgaggggagacctccaggcgcagggaaggacggccagggtgacacggaagcatgcgacggctgctgatccctctggccctgtggctgggcgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatanagacccaagttctgcgggaggctgangagcaccaggagacccagtgcctcanggtgcagcgggctggtgaggacccccacagcttctacttccctggacagttcgccttctccaaggccctgccccgcagcta

SEQ ID NO: 1879 - DNA, 443 bp, Homo sapiens
  misc_feature 57, 86, 87, 93, 166, 244, 250, 251: n = A,T,C or G
gttaacattgaccaagaactgcatggacctaacattcgatctcattcagtattaaanttcggtcgcgccgcgggttccgcgctgcnntggggnttgtggtttgcttctgttgtgctccgttaggacacagagtgtgggtgcgcgtcgccgggccctgtcggatgtngttttgtgtggggggtggtgtgcctgtgggtgtgcgtctgctggcggcttgcgttgctgggctctggtggttgcatcnacgagnngccggcggtggcacctggcgggggcgggtggaggcggtggtgtgccgcggtgtgttgtgtgggtggctgggggtggggtgggggtggcggtgtgggggtggtggtcgccgtgggtgcgcgggtggttcgttggtttcgggcgggttcgggaggggtttgggagggcgggggtggggatgtgccgggccgttg

SEQ ID NO: 1880 - DNA, 507 bp, Homo sapiens
tttattattttttttttttttctataaaacggaaggggaaaggggaccagaccaacaaaccccaaaaaaaagaaacagacagagggacagagaaggcagcaggggccgggggaaaaccgggaaaggggggggggggggggggggggaaggggggggggggggggaaaaggccccccccaggccaggaagggccccgggaaaaaggcccacccggcaagaacccccccccaggggggggccccgggcggaaaccagcgcccacaccaaaccccccaaggaagaaaggggggccccccggaagggaagacgcggaccgcaagcaagccccaaaaaacccccgggccccacgcgggcctgggggcagaggggggtgggggacagccccaggggcacccgcaaaaaggggggcccccggcccaaagccgggcccccggggccaaagccccccaagggggggccgataaaaggcgaaagcagggccaaggcgggtgcccggggaaaaaggga

SEQ ID NO: 1881 - DNA, 172 bp, Homo sapiens
tatacggctgcgagaagacgacagaagggtaaccagttgttggagagatctggcccctccccacaaattctctgtgtccctctaggatacctcaaataacaataatgatagcaacgataaaaagaagacccaaaaaaaaaaaaaaaaaaaaaaaaaaaagtcgtatcgatgt

SEQ ID NO: 1882 - DNA, 178 bp, Homo sapiens; identical to SEQ ID NO: 1040

SEQ ID NO: 1883 - DNA, 579 bp, Homo sapiens
ctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctc

SEQ ID NO: 1884 - DNA, 100 bp, Homo sapiens
gtgtcaccatgtgggtcccggttgtcttcctcaccctgtccgcgacgtggattggtgctgcacccctcatcctgtctcggattgtgggaggctgggagtg

SEQ ID NO: 1885 - DNA, 244 bp, Homo sapiens
gatagtcggcgagcaacgctggagcatcccgctctggtgccgctgcagcaggcagagatggttgagctcatgttcccgctgttgctcctccttctgcccttccttctgtatatggctgcgccccaaatcaggaaaatgctgtccagtggggtgtgtacatcaactgttcaacttcctgggaaagtagttgtggtcacaggagctaatacaggtgtcgggaaggagacagccaaagagctggctc

SEQ ID NO: 1886 - DNA, 601 bp, Homo sapiens
  misc_feature 254, 464, 473: n = A,T,C or G
tcggcacgaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttanccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcanggtcttcangaaagtctcgaaggaagcggcagatttatggctatgacagcaggttcagcatttttgggaaggacttcctgctcaactaccctttctcaacatcagtgaagttatccacgggctgcaccggcaccctg

SEQ ID NO: 1887 - DNA, 314 bp, Homo sapiens
cctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccccgaccatctctgggctccaggctgaggacgaggctgattattactgcagctcatatacaagcagcagcactctcgatgtcttcggaactgggaccaaggtcaccgtcct

SEQ ID NO: 1888 - DNA, 452 bp, Homo sapiens
tcggcacgaggttttttttttttccgggttatactttattatcattgcttaacattcggggtcccaccctgattgtgacctgggggcaggcaaaattgattcctgttttacttcactgcagtatctgcagcacccaggatgaagtccaggacaccaaaaatcaaggggcttcatgagtgaaactgtaagggctggctgtaacccccgtttttgggatgggaaaaggtgaggctgatctccaaagcaggtcccccccaccccacactttatcaaagtacctgaggcaaaatccccaatgatgcacccccaggggtctggctcctggggaaggcaatcaactttgccccaccaggtccagcaaataggccaagtggagtttcagggtcccgtggatggacaggggttcaccaatacccgcaaaaggaaccctaaggccatccaggttctccaaa

SEQ ID NO: 1889 - DNA, 613 bp, Homo sapiens
tcggcacgaggcaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttccttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtgaaaaaaaaaaaaaaaaaaaaaa

SEQ ID NO: 1890 - DNA, 129 bp, Homo sapiens
  misc_feature 16, 67, 86, 88, 89, 98: n = A,T,C or G
tcaccccaggagacanctccttggagctgtccattgcagaccacagggccaccagaatcaccctganaggaatcctggcctccctnanngaagcccgnacagaacatgttgctggtaatcttgccaggg

SEQ ID NO: 1891 - DNA, 386 bp, Homo sapiens
  misc_feature 1, 13, 27, 30, 38, 42, 45, 82, 85, 102, 123, 127, 140, 148,149, 232, 267, 341, 360, 373, 379: n = A,T,C or G
ngtcggatcctgngcggcagagaggcnatngcgcacgnggcnctnacatggcgtcggtgcagctgaacggcgcgcacctgtntcngcgtcactggtggcggnagttgggtgctgagcgcggcnactncctggaggacgcngccgacgnnaaggtgcaggttctcctgggcgcgcactccctgtcgcagccggagccctccaagcgcctgtacgacgtgctccgcgcagtgcnccacccggacagcaagcccgacaccatcgaccacnacctcctgctgctacagctgtcgaaaaaggcacactgggccctgctgtgcgccccctgccttggaacgcgttgnaccgaacgttgcaacgggnaattttctgcgangttgcnggttggg

SEQ ID NO: 1892 - DNA, 650 bp, Homo sapiens
  misc_feature 491: n = A,T,C or G
cggcacgaggcccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccangcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccg

SEQ ID NO: 1893 - DNA, 450 bp, Homo sapiens
  misc_feature 7, 35, 111, 321, 429: n = A,T,C or G
atgaatntggagttagcttttattaaacacaaatntaccagacactgtgccaggcacttcacatacagtatttcatttagtgcaacaatcctgcagtactggtcttaaccnaatgttgcaaatggggaatctgagattcaacaaggttaattagcttgcccgtaatcataagcacataaatgtgattctcaaggattccaaggcccttgctcagtttactggccatgctgttttcttgcattttatgtaggaagaacaggacccaggcatctccctccaccattgacctccagagaagagatgacacagttggaagggctntctaagacagacaggaaatggagttgggggccaaatctaagttaggggttctgagttaggggagcactttttcaggagtgaaaatgcacagggaagtggtggccgganttgggaagttttagaggcccg

SEQ ID NO: 1894 - DNA, 525 bp, Homo sapiens
tcggcacgagggcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctg

SEQ ID NO: 1895 - DNA, 475 bp, Homo sapiens
ttcggcacgaggcccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaaaaaaaaaaaaaaaaaaaaaaaa

SEQ ID NO: 1896 - DNA, 553 bp, Homo sapiens
  misc_feature 325, 431: n = A,T,C or G
tcggcacgagggggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccaaacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctancctggatgactacgtgaggtctatatctcgactggcacagcccacctctgtgctggacaaggccacggcccagggccaacccaggccaccccacaggccagcccangcctgccggaagggccgccctgctgtgtccctgcgagacatcaccgcacgtttcagtggccagcagcccacactgcccatggctgatactgtggaccccctggactggctttttggggagtc

SEQ ID NO: 1897 - DNA, 509 bp, Homo sapiens
cggcacgaggattccctacagcctagggcagacaatagtatagaagtctgggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctc

SEQ ID NO: 1898 - DNA, 560 bp, Homo sapiens
  misc_feature 437: n = A,T,C or G
tcggcacgagggtgggccatcatcttctttggtggaatacttgtccgcctgggcctccagggatttcaagttgttggtaacaattttcagctcctcctctaggtccccacatttactctcggccacctcagccctctcctccgagcgctccagctctccttccaggatcaccagcttcctggccacctcttcatatttgcggtctgaatcctcagcgatgtgcttggcctccttcagctgcatctcctgcagttccatcttctcctcatccttcatggcccggttttcgatgaccttcattcctctctcgctctcatcagccgccttctcggcctcctccagcttctgcagggctgtagccaggcgctcctgggcccggtccagctcctcctcaaccagctgaatgcggcggttcagggaggccacatctgcctcancatcagtggccttcttctcggcctgctccagtttctcctgggcctccttcacggattcagaatacttttccacctcatcctctgtccccttcagcttcttctggagggcctgctgctcctcct

SEQ ID NO: 1899 - DNA, 397 bp, Homo sapiens
  misc_feature 31, 229, 336, 345, 353, 359, 375, 386: n = A,T,C or G
gctatttctcccgtcccacagggcctgaccnggcccagggtggggtggggggctctggggacaggacatgcagggaggaaggggggggcaggattttcccgtgttttatccatttgcaagttggtcaccaatagaaatgggactctgagggctaacagaaatgggactctgagggctaacaggagagggcggcctggctctgggccccagccaggccccaggagtcctntcccctctgagaaggggagggagagagctctagaaaccaacggagaaacagagaagggggcaggggctcatttcagcaaacacggctacatcacgtgacacgccagnaccacaganacacacgncaacgnacacggctgcacagcnggcaggggctnttaaggggaaa

SEQ ID NO: 1900 - DNA, 622 bp, Homo sapiens
  misc_feature 197, 221: n = A,T,C or G
cggcacgaggcgcaccaacccccccaaataccccagcaagcaggtaggccagccctttcagctcagcacaccccaacccctaccccacccctaccacggagccatctggaccgaggtgtgggagtgatggagcaggtttactgtgcctgcccgtgttgggggccagcctgagccaacagtgggaggtggggccttantgcctcaccgggcacacggattangctgagtgaagattaagggagggtgtgctctgtggtctcctccctgccctctccccactggggagagacctgtgatttgccaagtccctggaccctggaccagctactgggccttatgggttgggggtggtaggcaggtgatcgtaagtggggagggaaatgggtaagaagtctactccaaacctacgtctctatgtcagaccatacctacgtgcttctctatgagggaaacagggagacctggggtcctgtggataactgagtggggagtctgccacgggagggcaccttcccattgtgccttctgtgtgtattgtgcattaacctcttcctcaccactaggcttctggggctgggtcccacatgcccttgaccctgacataaagttctctatttttgga

SEQ ID NO: 1901 - DNA, 543 bp, Homo sapiens
  misc_feature 252, 297, 367, 426, 478, 492, 511, 530, 541: n = A,T,C or G
tttgaaccaaattctcacttacccaggctggagtgcagtggatgatcatagctcactgcagccttgaactactaggctcaagcaatcctctcacctcagcctcgcaggtggctgggaccacaggcatgtgccaaatgcctagataatttttaaatactttttggaaagatggggtctcagtatgttgctcaggctggtctcaaactcctgggttttagcctcccaaattgttgggattacaggcgtgcactngtgcatagctaggaatgtgatctattcctaaagcacagtcagganttctcaccactggggcacccatttaggttgatgcaggcaggacacctgtggggctggcctggggaggggnatgggagtgggggagggagccatgttccccctcttgcaggggtccccctccctctgctngagtttaatcagggggcaaaacaatagagatgggcatctcagggtaggagtnatccagaagggggncaagggtagggagggcttnaccattgcatttttggggnagggaccaagnaa

SEQ ID NO: 1902 - DNA, 515 bp, Homo sapiens
  misc_feature 406, 417: n = A,T,C or G
acttctgggggggtacccgcacatcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcangcggagctgangcggaagtggcggcgctggcacctgcagggcgtcctgggctggaaccccaaataccggcacccgtcgggaggcagcaacggcgccacgtgcagcacgc

SEQ ID NO: 1903 - DNA, 563 bp, Homo sapiens
tcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaaaacctgcgagagctgcgcagacatgtgcacgccgacagcacggacttcctggctgtgaagatgctggtacagcgcgtgttcccagcctgcacctgcacctgca

SEQ ID NO: 1904 - DNA, 410 bp, Homo sapiens
cccagcgcgtttcttctcctgtatgcgtcactacttcctgaagtggacctcctcctggtcatgggtacctccttgcaggtgcatccctttgcctccctcatcatcaaggcacccctctccacccctcgcctgctcatcaacaatgagaaagctggccactcggaccctttcctggggatgattatgggcctcggaggaggcatggactttcactccaagaaggcctacaaggacgtggcctggctgggtgaatgccaccagggctgcctggcccttgctgagctccttggatggaagaatgagctggatgaccttgcccggatggagcacgccagcataaatgcccagtcgggggcgggggtccccaaccccatcacttcagcttcccccaagaagtccccgccacctgc

SEQ ID NO: 1905 - DNA, 535 bp, Homo sapiens
  misc_feature 446: n = A,T,C or G
cttggggagcccaagcagaaacgcaagctggtggctgaggtgtccctgcagaacccgctccctgtggccctggaaggctgcaccttcactgtggagggggccggcctgactgaggagcataagacggtggagatcccaaaccccgtggaggcatgggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccataccccagggcagggtgggcagcctatgggggctctcggaaatggaatgtgcccctggcccatctcancctcctgagcctgtgggtccccactcaccccctttgctgtgaagaatgctctgtgccataaacagtgggagccctgaccttggctgact

SEQ ID NO: 1906 - DNA, 603 bp, Homo sapiens
aaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttg

SEQ ID NO: 1907 - DNA, 340 bp, Homo sapiens
tttttttttctcttagtgtgttagaatttgaagttcaaagttgaataaaagcaactgcagcataaaagtataaatagctttctgtttaccacaatgatttggggagggctatactctgagtaatgcttccagcttttagaattgtaaactcaagccttacctgggaggccaggacttccaggacttccaggggctccctcaggtccagcaggccccaaatgtccaggtgggccaggttgccccatttctcctttctttcccatatcacccggcagtcctggatcccccttaaatgtagtcaaatacctttaaaattctcatataagcaggatatgtggta

SEQ ID NO: 1908 - DNA, 620 bp, Homo sapiens
  misc_feature 431: n = A,T,C or G
tcggcacgaggtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctanggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctc

SEQ ID NO: 1909 - DNA, 516 bp, Homo sapiens
cacagcaaacggagtgccaggcctgtcatttcacacctgtctcactcactccatgtgctcagaaaagaacacgtccaccgcggaggccgcaatgcccacctagagcaggtcgtagaagtagtccaggccctggcccagctcccagatagagaccccaacgcccagctcccgggccagctccagccgcacctgcagggacttcagggttgggtagaagacgacgtgcctcccactgcggctcttcttgtactcgaagaagtgctctgagacctggctgtcccacaccatccggggcctgtggtccttcagtgtctggatgtacctggccccgacaacaggctcacgggcatccttggaggtcgcgtagtccataccatagaagttgagccccaggaggattttgcttcgccacttggacttcgggtccaggacctggacgcaggctcgaacccaggacaggggtgcattagggccaggctgatgcgctgtagagtagtcgtaggtcatgaggctgaa

SEQ ID NO: 1910 - DNA, 287 bp, Homo sapiens
aagacccccgggggtaaagtttgcttgggaaaggagggtttttaggggggggaaaccagtatagggggggaaaccggttggattgcccaatcggggagggaaaagaaggggcccgggcgggcccaaagaaggggggagggagtgtttcttgagggccaaggaatgtggttagggaagggggggagggaatgtgaaggggaaattgagcacgggggggaaggttcccggggaaaaggggccccagaagatgagggggcccccgtgggcagggttaatgggaatagtac

SEQ ID NO: 1911 - DNA, 490 bp, Homo sapiens
ctttttttttttttttttaagtagagacaaggtcctgtgatgttgctcaggctggtcttgaaatcctgagctcaagtgatcctcttgcctcagccttccaaagtgctgggattacaggtgtgagccaccatggctggctgtgtatgtcttgtgtatgtcatggcatccttatatgtcttgtgtatttactcaatattgtatatgttttgtataactgtgccatctttattcattcccctgtcaataagtatttattatatctttctcttgtatttgtccttataaacaacgttgccatagcattcttgtaaatgtcttttttttttttttttttttaagtcagtgtcttgttctgtcacccaggctggaatacagcagcatgatcatagttactgtaacttcaaactcctgggctcatgtcatccttccacctcagcctcctgagtgccaagaccacaggtgcatgcctctatgcctggctcatttttaa

SEQ ID NO: 1912 - DNA, 601 bp, Homo sapiens
tcggcacgaggcacagactccacacatgcgcgcgcgcacacacacacacacacacacacacactgaaggcgaccctgagcagggtgtggtgcgggagtggggtggtaggacgcgaggggcacgctggtggccggagcctggctctcctcgagtccgtgtacctccacaacaaccagctgagcaacgctggcctgccccccgacgccttccgcggctccgaggccatcgccaccctcagcctctccaacaaccagctcatctacctgccgcccagcctgccgccctcactcgagcggctccacctgcaggtagccctgctaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgccggggcgcgtggtctgcgctatttgttgctgc

SEQ ID NO: 1913 - DNA, 484 bp, Homo sapiens
ttggaagatcaaattttatttactacctgcatacaaaaacatattgcacatcaaacaaccgaaataaaaaaaaaaaaaggaaaaaaaaaagatactctactgaagactaacatgtagtttatacagaataaaccttctggaaattgatcttttcagtagttcaggttatgtctgaatggacatgactaattcagcttagtgttttaactaaagctatgtttgatttttaaatactgtacactttaataaataaaccaaacaaagcctcaaggtagaacagtcactgccaagtatcgcccagtgtccctgcagatgagagtttaacaaatgtattccagtggtctgcagattttcctctacatacagcatttaaaaaacacattaaaacagaccagtttccagactaaactaatgaagaaattacaattcagtgcaaaatattttagactgcatttcattctagttttcctcaggtgaagaagtg

SEQ ID NO: 1914 - DNA, 545 bp, Homo sapiens
  misc_feature 187: n = A,T,C or G
tcggcacgaggtccaagccaacatttattgttgcacaagcctgttgcagtcctgaggggatcttctggcagaggtgtgggtaggaagctgagtggccactggggtgaagggcagacagaggaggctgtgaccagcaggctcctatccagatgatacatgagatggaggcctcctcagccacactccnaggagggtggggtggcaagggggattcagggataatggcattaataatacaagtggtaaacaaataaccaagaggatctggctggttacgatacacaaaagttagcagtaagagtccgtgctttcacattcctatcagacagatctgagttcaaatcctgtatgtgtagcagggtgaggtatctgctttctgtcagagcccatgggtgcacatctctgagcctagttacaacagttggcacataggtgggtggacaaggagggcagctcttgattcctgttgcttccacagcacagagagataagtatgggctggtgtgacagatcccacttgacagatgaagccactgagacttgga

SEQ ID NO: 1915 - DNA, 252 bp, Homo sapiens
gagaagacgacagaagggatggtcaccacctgtcacaccacatccaagagcaggggacagaaagagagagatgcagctgtgagatgcaaaagcaggccgggcgtggtggctcacgcctataatcctagcactttgcagggctgaggcaggaggattgcttgaggccaggagttcgaagccagcctgggcaacatagcaaaaccttagtctcttactaaaaaaaaaaaaaaaaaaaaaaaaaagtcgtatcga

SEQ ID NO: 1916 - DNA, 398 bp, Homo sapiens
ccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcctggcaaggtagtggaagactggctgagcctggtgaaggccaagttctgtgaggcccccggcagctgcgtggctgtgcactgcgtggcgggcctgggcgggctccagtccttgtggcgctggcgcttattgagagcgggatgaagtacgaggacgccatccagttcatccgccagaagcgccgcggacgcatcaacagcaagcagctcacctacctggagaaataccggcccaaacagaggctgcggttcaaagacccacaca

SEQ ID NO: 1917 - DNA, 166 bp, Homo sapiens; identical to SEQ ID NO: 1090

SEQ ID NO: 1918 - DNA, 363 bp, Homo sapiens
aaggtgacacatattctgtctgtccacgatagtgccaggcctatgttggagggagttaaatacctgtgcatcccatcagcggattcaccatctcaaaacctgacacgacatttcaaagaaagtattaaattcattcacaaatgccgactccgcggtgagagctgccttgtacactgcctggccagggtcttcaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctg

SEQ ID NO: 1919 - DNA, 635 bp, Homo sapiens
tcgcgcgcctgcaggtgcgacactagtgggatccaaagaattcggcacgaggctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggccccccctggaatctgtgaatcatgccctactggtcctcagaactattctccccagtatgattcatatgatgtcaagtctggagt

SEQ ID NO: 1920 - DNA, 566 bp, Homo sapiens
cgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctg

SEQ ID NO: 1921 - DNA, 109 bp, Homo sapiens
gtgcccagctctcggaatgactgtggctccactgtccctgacaaccccttcgtccggaccctcccccacacaactatgtctggtcaccagctccctcctgctggcaccc

SEQ ID NO: 1922 - DNA, 513 bp, Homo sapiens
gggagccccaagcttaccacctgcacccggagagctgtgtcaccatgtgggtcccggttgtcttcctcaccctgtccgcgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggct

SEQ ID NO: 1923 - DNA, 375 bp, Homo sapiens
gaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacct

SEQ ID NO: 1924 - DNA, 471 bp, Homo sapiens
ggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgacttcaaatgcttctgatgctttagataagataaggctaatatcactgactgatgaaaatgctctttctggaaatg

SEQ ID NO: 1925 - DNA, 480 bp, Homo sapiens
ttttttttgataatagattttcttttagtgatgaaattaatcttgttttggtaatctacagcctgttagggataggtggagggatgaagtccttaaaactaaattgttcctctacgaatcttcgacctgagcctgcggagagagtagccccaaatccatctctctgctgaaaggtcgcctgttttggtaggtgtgaggacattccgaaacacggccatccacattctgatacatatttaatcttatgttgatttcaccatgtggctgctcctgcttcagaacttctgcagtgtcccaggacttcttgctgcctttgtgttacccttgtccttgtttttcccaggcatcctctgtggtgggttttccctctgcggtgcaattttaactgctttcattgtctcagggattttccacagtttcgcttcttctgcatctgccagctgacatcctaaaaacgaagtcaaattagggaaggatggc

SEQ ID NO: 1926 - DNA, 592 bp, Homo sapiens
tcggcacgaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctgggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaag

SEQ ID NO: 1927 - DNA, 511 bp, Homo sapiens
tcggcacgagggaggaaagtcagtctactcccttcttcctccccccaaacacgtgttctcttttgtcaggaaactcagccagtggactgtggcagagaaagtcctccactcagaggcagagactgagttaagtcataggtggccttaggcatctgcattgtttgcaggggttaagttttccttccagtgagggctggagggatgaattagctggtacctgaagccccgcttagctctgacactctgccaacatcctctgattctaggtgtggtgttgactgtcctttcaaggaaaaacttgcaatagagggaaaagccattaaagcagctccctgcttcatcattaagtcctgtcatccctaccagccaatcccagtcaaagaagttatgctttattcacttctgtggaattacaagtgagagacacttttaggacctgatggacaaagcaggagattcactgtcagctttcctggtcctctccttacttctgtgggccttgcaccgtctt

SEQ ID NO: 1928 - DNA, 546 bp, Homo sapiens
  misc_feature 509: n = A,T,C or G
gagtgggatctcactttaatggagaggacgttatgacctccggggcatggctcttggccttgggcaagcccctggttttcatggacctgtcgatccacttgaggaaggcggtgaccttggtgtagatcccgtacttccccttacgggcacagcctcctccccagctgacgatgcctgtcacgaagtaggtgtccttgaagcgggtgacgtgcgggcccccgctgtccccctggcaggcatcctcctgcttggtgtcgtagccggcacagaacatgttctgggtgatgatgaagctgctggacagcttgcagctgttgcggtccacgtagggcacctccagcatcttgagcctggtggactgccggcccttctcgtgggtgcgccgaagccgctcacaatccccgtcttctgcgtcatcagcgtggactcggcccagtcacgctcggggaggcaggcaggcgcaacgttcatgcggaaggtgatgggggtcttgagccggagcagggagntgtcgaagtcataggtctcctttgtgaacgggtgtgc

SEQ ID NO: 1929 - DNA, 429 bp, Homo sapiens
  misc_feature 420: n = A,T,C or G
tggccaagttggttgcctttcggtgatcagccccacacaccccatcccacatccccgcccgactccccccactctctcttgccttccaccccagccggggctgcaccagcaccgcgagcacctgtggtcgcagcagcaccggcgcagcagccacccacgcacatgcatcagcccagaacgccttccccttctcagcaactggcaaggtgcaatccgtccccacacaccacgccacgactcgcttgcacccgcctgatcacagcatggcgtacccacgcaacactcggctagccactctgcagacagacactggcaacaccgcgcgacacctccagcaagcgacactgcaccacctcccctgtgatatccagcacctcagggtcgctacacgcctgcactgtcgcacacccgctccatcanccgcccaaa

SEQ ID NO: 1930 - DNA, 545 bp, Homo sapiens
tcggcacgagcggcacgagcatagggctcggcgtggagtcttggcagcagcctccactcctgggcatggcagggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgaaaagttctcggaggtgcttaagcggctgcgacttcagaagcgaagcacaggcggtgtggacacggctgcggtgggcggggtcttcgacgtctccaacgctgaccgcctgggcttct

SEQ ID NO: 1931 - DNA, 455 bp, Homo sapiens
gtccaggaagaattgtgtcttttttggagagaccagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttaccc

SEQ ID NO: 1932 - DNA, 473 bp, Homo sapiens
tcggcacgagcgaaatggcttctgggcaagaaaaagcttattctaggaagaaatgctagtgagcagattttaaaacaatatattctaattattctacaccattttcttttgctctagtttcttactgctcatggattacatcggtattaacttggcaaccatgaattcatgtataaaccccatagctctgtattttgtgagcaagaaatttaaaaattgtttccaggtaagatgatttttcaagtattttttaaagacaacaaaatgagtatattaaacagtcaacagacacagccaattccagttgtaatattactttgatcagctatactactttttagcagtgaagtgaaaatcatgttttattacccagaaagagagtcagattgtcggcataacagaaaagcagttcctatttagacaaccacatacaaagaggttaaaatcaaaaggactaaatcacatgccagttt

SEQ ID NO: 1933 - DNA, 577 bp, Homo sapiens
ttcggcacgaggaccagcacactgaccatcaaagagagcgactggctcggccagagcatgttcacctgccgcgtggatcacaggggcctgaccttccagcagaatgcgtcctccatgtgtggccccgatcaagacacagccatccgggtcttcgccattcccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccaccttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgc

SEQ ID NO: 1934 - DNA, 505 bp, Homo sapiens
  misc_feature 370: n = A,T,C or G
tcggcacgaggaggccatggacttcctggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcanggaaaccagggtccggggcaggcccggcgctttgctccccacaccagccccctgcgcgtgtccactctgatcctgcatcccactccctgggagccaataaagtgcattttcacaggcaaaaaaaaaaaaaaaaaa

SEQ ID NO: 1935 - DNA, 500 bp, Homo sapiens
  misc_feature 314: n = A,T,C or G
acagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtgggcatcatcgtgggcaccgtcctcatcataaagtctctgcgttctggccatgacccccgggcccaggggaccctgtgaaatactgtaaaggtgacaaaatatctgaacagaagaagacttangagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgaataaatgttgacac

SEQ ID NO: 1936 - DNA, 561 bp, Homo sapiens
ccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccaaggcagggctgatagccaggcccagctgctgctgtccatggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccatgagttctgggtggacaacagcacctcagtgtctgttcccatgctctctggcatgggcacct

SEQ ID NO: 1937 - DNA, 523 bp, Homo sapiens
  misc_feature 460: n = A,T,C or G
tccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgangctgcctccccgctgtgcgtcaacgcgcgttgcctcacacggatggctccttccgctgcatct

SEQ ID NO: 1938 - DNA, 586 bp, Homo sapiens
tcggcacgaggatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtccca

SEQ ID NO: 1939 - DNA, 671 bp, Homo sapiens
  misc_feature 472, 494: n = A,T,C or G
tcggcacgaggcaaagacctctgaggccccgtccacccaggacccctccacccaggcctccactgcgtcctccccagccccagaggagaatgctccgtctgaaggccagcgtgtgtggggtcagggacagagccccaggccagaaaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccanggctgccctcgaaagatggcangagagatggcggagggccttcgctacatcccccggagctgtggtagtaattcatatgtcctggtgcccgtgtgaactcctctggcctgtgtctagttgtttgattcaaacagctgcctgggatccctcatcctcatacccacccccacccaagggcctggcctgagctgggatgatt

SEQ ID NO: 1940 - DNA, 303 bp, Homo sapiens
  misc_feature 230: n = A,T,C or G
agctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctancgatctctcctggcctatccgctgccagccttgagccctggctgttctgtggttcctctgctcaccgcccatc

SEQ ID NO: 1941 - DNA, 568 bp, Homo sapiens
cggcacgagggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacag

SEQ ID NO: 1942 - DNA, 402 bp, Homo sapiens
  misc_feature 292, 317: n = A,T,C or G
gttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcangaggtagctggtgctgggctcctantcttggcagaggagcccaaagcacttggctgccctgcgtgtcactcatctccctttgcctcccagctggagtccctggatgccct

SEQ ID NO: 1943 - DNA, 576 bp, Homo sapiens
  misc_feature 367, 490: n = A,T,C or G
tcggcacgagggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgangaaccgcatcgctgcctccaagtgccgaaaaaggaagctggagagaatcgcccggctggaggaaaaagtgaaaaccttgaaagctcaaaactcggagctggcgtccacggccaacatgctcanggaacaggtggcacagcttaaacagaaagtcatgaaccacgttaacagtgggtgccaactcatgctaacgcagcagttgcaaacat

SEQ ID NO: 1944 - DNA, 383 bp, Homo sapiens
ttatttagtttttatttcataatcataaacttaactctgcaatccagcgaggcatgggagggaacaaggaaaacatgggacccaaaggggaccgccggggggcgccaagaatccagggaaccggcgaccaaaggggggggaggggggcccccctgaccaccagagggaaggaccggggggtaaagaaaaaacacaggccaaactaatccgggtggcccaaggtcgccatgggggacctcctggcgggcctggcaatcccgggcccaaagcggcccaagggcccccacaaaaatcatgccttccttcactttgccaaacaccacatgcttgccatcccaccactcacgcttggcagtgcagatgaaaaactgggaaccatttgt

SEQ ID NO: 1945 - DNA, 434 bp, Homo sapiens
  misc_feature 376, 385: n = A,T,C or G
gcggccgcagcaccgcagcgtagcgctcgctgctcatgacggtcagcgtgaagatgctggcgtgcatggtcaggaagtccaggccgaagagcacgcggcagcccacgtccccgaagtgccactccttggtgacgtaggtggccacgatgaaggggatgctgagcaggtacagcaggtcggccagcgccaggttgaccacgtagacgtacatggaggccaccgcacgcagggagcggcaggtgaccaccagcgtgtaggcgttgcccaccacgcccaccacgcccatggccgacagcagagtcccaatggtgcccgtggccaccaggtcctccagggagctgggctcggtcgggctggcccaggagctgttgaggtntgctttggnggccgccaggcggctccggcacagagctgccagtgggcggccagcccag

SEQ ID NO: 1946 - DNA, 580 bp, Homo sapiens
  misc_feature 424: n = A,T,C or G
tcggcacgaggctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctaaaccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccanggcttgtgtgggtcgagagcgccctcatggtgctggtgctgttgtgtgtaggtcccctggggacacaagcaggcgccaatggtatctgggcggagctcacagagttcttggaataaaagcaacctcagaacaaaaaaaaaaaaaaaaaaaaaaaaa

SEQ ID NO: 1947 - DNA, 350 bp, Homo sapiens
  misc_feature 64: n = A,T,C or G
acgcaacaaggcgagggacctggccctggccatccgggacagtgagcgacagggcaaggcccangtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatg

SEQ ID NO: 1948 - DNA, 433 bp, Homo sapiens
tataaatataaatttccatatgatttattgttgttccttgtacataagaaacagtaatatacaacttacactgctttagaatgtaaaatggataaaaatgtgtacaaaaaaaagcacactcctagaaaaaggtattggcaaatagtaaaaatgggaggtcaaaagcaaaaaaaaaaaaaacaaaacaaaaaaaagaaaaaaccaacaattcttcaattcagtgtgcaaacattatataaaaatagaaatactaactctacaggcagtatttcctgataaattatttaaatagcatatctacacaatctgagatatctattccaatggcaatgagaaaataatttataaaaataaagcaatggtataccagatgatagaaaaaaaacataactttcagaaattgtatttaacatttcaatgctatttccttatt

SEQ ID NO: 1949 - DNA, 536 bp, Homo sapiens
  misc_feature 508: n = A,T,C or G
atacaaaaaccttttattgactgtatttcttctccccataacctggaacccagccagcatctatggcttcctgctgtctgattcttgaaagtggggccttgggaacatgtttggaggctatggaaggtgggaatctcctcacccaccggctatgcaggttgaaggaagctttcttgcctggctgaagctacggcagcttcccagggtagcccctcaagtctagaggacccatcccccactaaatgggtgtgaggaagagatgatgcatctttcagaggctttgtcactcactgctcctatcccactccagactgaggccctagagccgaaccagtctctcctgtggagatggggcccagcagcgaggggagggggttagaggtgagtgtgtgcagcagctctgggtcctcatcaacaaaaaggaaacgcaaagaggttggcaccgctgaaactgaactgaaatggaacaggagaaggaggatataggagaacaaaagatgggtttggngtagtgccacctattaagagaggacatg

SEQ ID NO: 1950 - DNA, 445 bp, Homo sapiens
  misc_feature 410: n = A,T,C or G
tttgtaaagtgacccagttttattttggttttggaggccagacagggcattgctccacgggttcgggctgtacaaccttcccctccttgaggtgggaggcccagcaaccacagggcccaggcagcggggtgggaggctcaggagatggtggctctggggacccgatcccgaggagagagggggcagcaggcagaggcctgcaatggctcagattgggggaagagggcggcgagggggagaggacacgatccaagaaccagagtccgaaagctgaagctggtccggtctctttcactttacggccgaggctggggtcagagaagtgaagccaaactgtcctcccgcaggaggcaaggcctggagggacgccagggtcccagtccggtgccgggccctgcgcacacagccgncgcctccaccctcgcggaggggcgcgcgcgggccc

SEQ ID NO: 1951 - DNA, 221 bp, Homo sapiens
gagaagacgacagaaggggaagctgccaaaaatccctacaaacggagggttgggccacctgtggccaccagaaaagccaaggttggggttggttcaccacccaatttccagttaaaaggcggattgggccgggaccgtggccagccacttaattaaaatgggaaaggatcttttggcttggattaaccttccggccaaaaaaaaaaaaaaaaaaaaaaaaa

SEQ ID NO: 1952 - DNA, 399 bp, Homo sapiens
cgtgggcggagcggggctggccagcctcggcccccagacccgctgtcctgtgccctttcccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacaagcgacagctgccccggcctcaccctgcaccgcctgcgcatccccgacttctgcccgccggcccccgaccagatcgaccgcttcgtgcagatcgtggacgaagccaacgcacggggagaagctgtgggagtgcactgtgctctgggctttggccgcactggcaccatgctggcctgttacctggtg

SEQ ID NO: 1953 - DNA, 601 bp, Homo sapiens
  misc_feature 230: n = A,T,C or G
ttcggcacgagcctccgcgccttctccgccgggacctcgagcgaaagagcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttantcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcaatcagagggcagaccctgtgaatataactccagaatctaccaaaacggggaaagtttccagcccaactgtaaacatcagtgcacatgtattgatggcgccgtgggctgcattcctctgtgtccc

SEQ ID NO: 1954 - DNA, 122 bp, Homo sapiens
gaaggcggcaacagctatggggaggtcaaggtcaagctcatcgtgcttgtgcctccatccaagcctacagttaacatcccctcctctgccaccattgggaaccgggcagtgctgacatgctc

SEQ ID NO: 1955 - DNA, 485 bp, Homo sapiens
gactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatatggggtgctgaatagcttggcgaatgtcctctcacagcacctcaaccaaaaagacaccctgatgcagcgcttgcgcaatgggcttcagaattgtgccacacacacccagcccttctggggatcactga

SEQ ID NO: 1956 - DNA, 290 bp, Homo sapiens
tcggcacgagctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggccgagg

SEQ ID NO: 1957 - DNA, 519 bp, Homo sapiens
tcggcacgagggggagattagcaggaacagcctccttcactgactggttgctcctgaggcttttccagttttatgtcaatcatatcttctctgcttctgtcctgtgtgctttccattcccggcaaagctgctgctacacgtcgaaagagctgctttacattgtatccagcttttgcactagtttcaataaacataacattcagctctttggctttcctctctccctcctcaattgacacttgcctcttgtcagcaagatctgttttatttcctactagcatgatgataacatcacttcctctttctgttctgacatcatcaatccactttgtagtttgctggaatgagttaacatttgtgatatcataaacaacaactgccacagtggagtcacgaatgtagctaggaatcaagctcctgaaccgctcttgacctgctgtgtcccataattgcaatcgtactgttcgatcctccaagtacatagtttttgataaaaagtcaatgccaattgttgcctga

SEQ ID NO: 1958 - DNA, 386 bp, Homo sapiens
gcggccgccttgcgctcggtcatgatggctgggtacttgagtgagtggcgcacgcccacgtaccggtccacggagatggtgcagaggctgaggatggaggccgtgcagcacagcacgtccacggcggcccatacgtcgcagaaggcgcggccaaaggcccagaagcccagaacctccatggtggccgagaagggcagtacggtggcgctcagcagcaggtcggccacggccaggttcacgatgaaatagttggtgacggtctgcaggtggcggttgcaggccactgagaggatgacaagcaggttacctgccacggccataaggatgaaggctgccaggaagacgcccacgcccacgccctgcgcgctcaccaccagtcccccgac

SEQ ID NO: 1959 - DNA, 734 bp, Homo sapiens
  misc_feature 300, 387, 628, 649, 673, 675: n = A,T,C or G
gcggccgctacagatgcgtcagtttgggagcctccggcagtcgtccctgagacgagtggtgggccgagagatctgtgtaggtgggatgagggtcgcaaggtccatggtggtggttgcctggaatctgcgcggcgcaactgtagtccacgctggccgacgacgggtgcgagaggtggcccaggttgaagacaggcccggacgcgggcgccatggactcgacgaagttgccgcccacgtacaccgggctgccctgcaggttggcgctggcgaagccgccgccgttgctcgccatgggatggngctcgaactccggcgctgcgtagcgcttctgttgtggcaggcagctgctgagtggcgccgtgtaggcggccaggccgtacatattgngctgtgatttggcgaaagcaggcggcgagggcgcgtcgtaggccaggccgggcactggcggcagctggccggagtaggccacgtggccagcggcgccgccgagcggtgggctgcgctcaggggactggctagccggcgagtgcaggatgcccttggccttctggtccttcttgtacttcatgcgccggttctgaaccagatcttgatctggcgttcgtgagattcagcagtttgccatctncacgctgcgcggtcggcacangtagcgggtgaagtgtatttcttntncaattcaccagctgcgcgctcggtatgccggcgtacccgcttggatgctggcctggcgg

SEQ ID NO: 1960 - DNA, 475 bp, Homo sapiens
  misc_feature 104, 111, 332, 438: n = A,T,C or G
gcgacagcggtggtccctttgtgtgtgaggacagcatctctcggacgccacgttggcggctgtgtggcattgtgagttggggcactggctgtgccctggcccanaaaccangcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccanggtcctctcttccacagtggcgggcccactcagccccgagaccacccaacctcaccctcctgacccccatgtaaatattgttctgctgtctgggactcctgtctangtgcccctgatgatgggatgctctttaaataataaag

SEQ ID NO: 1961 - DNA, 467 bp, Homo sapiens
tcggcacgagggaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacgtctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatg

SEQ ID NO: 1962 - DNA, 510 bp, Homo sapiens
tcggcacgaggtgagaacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactc

SEQ ID NO: 1963 - DNA, 450 bp, Homo sapiens
ggccgcctgtgctggctctgcttccgtggtcggatcctgtgtgtcggctgagaggccgatgcgcactgccggcccctacatggctgtcggtgcagctgaacggcgcgcacctttgcggcggctgtcctggtggcggacagtcgggtgctgagcgcggcgcactgctttggaggacgcggtcgacttgaaggtgcaggttctcctgggctcgcactccctgtcgcagccgtagcccttcaagcgcctgtacgacgtgctccgcgcagtgacccacccggacagctagctctacaccatctactacgacctcctgctgctacagctgtcgtagaaggtcacactgggccctgctgtgctccacctgccctggcagtcgcgtgtgactgcgacgtggcaccgggaacttctctgtcgacgtggcctgctggtgcatagtcaaaccacgctggg

SEQ ID NO: 1964 - DNA, 579 bp, Homo sapiens
  misc_feature 458: n = A,T,C or G
tcggcacgaggtgggcccagaaggttgcgatgaagaaaagcgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggaatgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccancaggtggggagggggtttgggggcttgcaagtatgttttaacatgtgtttggttctggggcccctttttactccccttgagctgagatggaacccttttggcccccgagctgggggccatg

SEQ ID NO: 1965 - DNA, 476 bp, Homo sapiens
  misc_feature 85, 360, 396: n = A,T,C or G
ggagcggacatcgccctgctggagctggaggagccggtgaaggtctccagccacgtccacacggtcaccctgccccctgcctcanagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcangcgggcgtggtcagctggggcgagggctgtgcccancccaaccggcctggcatctacacccgtgtcacctactacttggactggatccaccactatgtccccaaaaagccgtgagt

SEQ ID NO: 1966 - DNA, 437 bp, Homo sapiens
tgggcaagaccaagtacaacgccaacaaaacccctgacaagctgcagcaggcagccctgcccctcctgtccaatgccgaatgcaagaagtcctggggcaggaggatcaccgacgtgatgatctgtgccggggccagtggcgtctcctcctgcatgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaaaaaaaaaaaaaaaaaaaaagggggggcccaaattttttcccttttagggggggtaattt

SEQ ID NO: 1967 - DNA, 218 bp, Homo sapiens
cctcctgccatatgcctctcacggactatgaagtatggttgggcaccctgttccataacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcct

SEQ ID NO: 1968 - DNA, 409 bp, Homo sapiens
gggcgtacacacggtcatgctgccccctgcctcggagaccttccccccggggatgccgtgctgggtcactggctggggcgatgtggacaatgatgaccccctcccaccgccatttcccctgaaccatgtgaaggaccacataatggcaaaaccacatttgtgacgcaaaataccaccttggcgcctacactgaatacgacgtccgcatcatccgtgacgacatgctgtgtgccgggaacacccggatggactcatgccaaggcgactctggagggcccctggtgtgcaaggtgaatggcacctggctacaggcgggcgtggtcagctgggacgagggctgtgcccatcccaaccggcctggcatctacacccgtgtgcacctactacttggactggatccaccactatg

SEQ ID NO: 1969 - DNA, 658 bp, Homo sapiens
  misc_feature 383, 582: n = A,T,C or G
tcagaaaaatcacattttattgatcacttttatttaaaattacaaaaatataaataaaaatagtgaaatataaatattcagtgtacaggagtggtcctcaccccacccagtgaggattggatgaactaggctaaaaggaagggataactggccaagaaagggacatctatgtgaaagtgaaactgagacagtgctggtcacaggtcatgctgcagaataatacattcccaggcactgtcacgtgggggacccaagaggccccaggagtgacctataacctctccagaaagaccactctgtgtggcatcacagtccacacagtttaaggaaatatttagacttaacaatcagacaccagctcttactcacacttacactcacangccacacacaagtgtgcaaacatacacacacatatatatttcctgatacattcatggaatatcagagccctgccctgaagtcgttagtgtctctgctccccaaaccgctgctcccacattggctaagctccctcaagagacctcagctgttacacttcctaattgggaaattatcatttctcaaccatgggcctcacanatgcccaccgtcgggggagctggttctccctcacccatgcaccagagatgccctgccctttttactcctgcaggct

SEQ ID NO: 1970 - DNA, 156 bp, Homo sapiens
tcggcacgaggccgacccatcctcaccaggccgggcccctctgctcatgaccaggccccaccccatagccgccctgaggcctggcaggggcctctggagcccgcacacccctctccttggcaaccccctccatcctgggcccttcggctttcccac

SEQ ID NO: 1971 - DNA, 486 bp, Homo sapiens
  misc_feature 58, 369, 379, 387, 392, 435, 473: n = A,T,C or G
cgccaccatgccgccctacaccgtggtctatttcccagttcgaggccgctgcccgtgncggcattgctgctggcagatcagggccagagctggaaggaggaggtggtgaccgtggagacgtggcaggagggctcactcaaagcctcctgcctatacgggcagctccccaagttcaaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatggaggcgggcaagggatgactatggtnaaaggcactncccggggncaaantggaaagccttttttgagaacccctggcttggttcccaggaancaaggggaaaggccaagaactttttaattggttggggnagaaccaggattt

SEQ ID NO: 1972 - DNA, 420 bp, Homo sapiens
tcggcacgaggaatacctggagggcattatgagcgaggccccggggcccatcaacttcaccatgttcctcaccatgtttggggagaagctgaacggcacggaccccgaggatgtgattcgcaacgcctttgcctgcttcgacgatgaatcctcatgtttcatccatgacgaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctc

SEQ ID NO: 1973 - DNA, 466 bp, Homo sapiens
attcggcacgaggcagcgcggcggcgccggccgtattctccgggctgcggaggggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcgg

SEQ ID NO: 1974 - DNA, 444 bp, Homo sapiens
  misc_feature 366, 398, 439: n = A,T,C or G
ctcggcgtgaacatcccgtctgatgagggccacatccccctgcacctggcggcccagcatggtcactatgatgtgtctgagatgctgctacagcaccagtctaacccgtgcatggtggacaactcggggaagacgcccctggacctggcctgcgagttcggccgcgttggggtggtccagctgctcctcagcagcaatatgtgtgcggcgctgctggagccccggccgggagacgccaccgaccccaacggcaccagccctttgcacctcgcagctaaaaacggccacatcgacatcatcaggtaggagccggtagcaggggaggggcctcagccttaggggtccccaggggtttcagcagcagcngggggtttcaggggcaccagtttttgggtttnggggataaggggcgggacaagggcagggttcccagggtccntggtt

SEQ ID NO: 1975 - DNA, 502 bp, Homo sapiens
ttcggcacgagggtgcacccctggataacgcccccaagagtaccccccccccaagaacagcagcgtgaaaaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggaaaaaatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgccc

SEQ ID NO: 1976 - DNA, 452 bp, Homo sapiens
aaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatccca

SEQ ID NO: 1977 - DNA, 504 bp, Homo sapiens
tcggcacgagggggaagctggtgagaaggcacactctctccacagttagatttgggaggaggcctgacttgggagagggatccaggctcacaccgccctgtcctgtgtcctgtctgcagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagaaaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtc

SEQ ID NO: 1978 - DNA, 459 bp, Homo sapiens
  misc_feature 19, 22, 23, 29, 69, 91, 319, 353, 423, 428, 455: n = A,T,C or G
catgagggggcccggcatngcnngtactntcctggcagatggcaaggtgttcaccacaggcttcagcanaatgagcgagcggcatggcgcntctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatggggcagcatgcaaagncggggcctgggaggtcagcaagtgcgagattcgnccggtttttacaaattgcatgagcgcaatgttgagcccttcgtcatgattgttgccaagaaattcggacnttttncaggttgtttttttaccccgacaaagncggg

SEQ ID NO: 1979 - DNA, 430 bp, Homo sapiens
  misc_feature 405: n = A,T,C or G
ctaaggaaaaatttaatgatggaaatatcgacaaatattcaacatcatttaaaaacaaagtagcttctcttatttcacatagcttagtttgggatagaaatagaactaatgtttacaatgattcttacatttagcattaatcagaaacgagggtttgttaagtgcccttgctgggtcccaacccccagagattccgattcagcaagtctgggatgcggcttgagaatttgcatttctaacaagtttctagggtgatgctgatgtcaatagtctgtgtaccgtttgaggaaccgctgggattggattctttgacagtttttgaaggtcccgctggctcacccatatccacttcatccctcttattaaacttttcactatggggattgccctaaggggcccctgctngttgggctgctcccccatttttcac

SEQ ID NO: 1980 - DNA, 546 bp, Homo sapiens
tcggcacgaggtacacagaacacacgctccttcaacttatctttgataaacccaagcaaggatacaaaaagttggacgacattgagtagagtcatggtatacggtgctgaccctacagtatcagtggaaaagataaggaaaatgtcactactcacctatgttatgcaaaacagttaggtgtgctggggctggatactgctcttttacttgagcattggttgattaaagtttaggtaccatccaggctggtctagagaagtctttggagttaaccatgctctttttgttaaagaagagagtaatgtgtttatcctggctcatagtccgtcaccgaaaatagaaaatgccatccataggtaaaatgctgacctatagaaaaaaatgaactctacttttatagcctagtaaaaatgctctacctgagtagttaaaagcaattcatgaagcctgaagctaaagagcactctggtggttttggcataatagctgcatttccagacctgacctttggccccaaccacaagtgctccaagccccaccagctga

SEQ ID NO: 1981 - DNA, 534 bp, Homo sapiens
  misc_feature 379: n = A,T,C or G
cggcacgaggggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtaagtgaaccaagaaacaaagtcaaatcctcaagttttgacttagggtagaaagatgaatattagctgaattctgtgcattaaaatcacattttttccagaaaatctagttttggttagggatgggctacaggaatttacaatttaaagttcctcangaattccattgccatccgctgggctgtgactaccattgggaaaaaagctcttaatgttttgttactttttttgttgctatgcggattttttaaaaatcatggctataaagtcaggtggcttttggaggagaattactacttttcttgacatgatg

SEQ ID NO: 1982 - DNA, 557 bp, Homo sapiens
  misc_feature 381, 383, 448: n = A,T,C or G
accctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccananccttcgggggacttccaaggaagctgcttcagacccctctgactctccaaaccttcccacaccanggagctggtgggagcagttgacccaggcctcccgggtctatgcctctgggggcactgagggctttcctctttcccgatgggcaccggggcgtcatgggactgcagctga

SEQ ID NO: 1983 - DNA, 541 bp, Homo sapiens
cgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcttgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgccgccacttctggttcacaaccaagagctggaaacccagctccgagcagatggaccaagaccacagcagcagtgacagttggaacaacaatgatgctgctgcctccctggagaactccgcctcctccga

SEQ ID NO: 1984 - DNA, 486 bp, Homo sapiens
atagtccatgtccctcttttatatgggtgataatttcaaagtactatagccagagtcccaggaaggttctagtcacccttgtaccccaaaagccagtctttccttaggctctgagctcctcaggctagcgctggtcccagtctgcacatctcagaccataccctcttcctatacaggaggtggggcaggctttcagccctcaggtccagtgtggggagcggcaggagcaggagggctgggatcctccagctgcacatcatgcaggtgcactgtgggggtggtggggtctttgcccacaccctggtttgggtcggcttggtcagggtggtgcctgcgtacgtgcttgaccacctggaacttttgcttggccttgtagttgcagaggcggcaaaagaaggggtggcggtcggtgtgggtgagggcatgatggcgcaggccagcagcccagcggaaagcacggtggcacacatttgcacacataggttt

SEQ ID NO: 1985 - DNA, 377 bp, Homo sapiens
ctggtgcccgctcgcatgaccgtgcgcggcaccgacggccgccccgcctagctccatctacggccgcccacgccgctcagcgcccttcctcactccgggacctggtcaggacccccgggcccctggcaccccaacgccgaactgcctccagggaggccacctgggaaccccggacctgaaccccgagtccccctcggataccctaacaccgcatattcggtacccccatatccggatctcaaatcccaaaccccgaaccccacggggctttgataaatcgtggctcagactccccactagtcccaggaccccatctcgggtaccaccaggctccacgcagttctagccccacaccttgatcgcccgcagcaggtact

SEQ ID NO: 1986 - DNA, 527 bp, Homo sapiens
tcggcacgagggtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtgga

SEQ ID NO: 1987 - DNA, 406 bp, Homo sapiens
agtccaaacccacacggtttatttggggggggggccaagggggccccggtggccaaaaaggggaaatttttcaaagcccccggggacggcaactttttttattagggagggccccaggacacctgggccggggaagcccccccccccacaaagtccctggccggggagatgggaggccagcccccctgggccagggaatccaaaatgaactcccccgggcccacccccacctcggaaggggggtgggggcaaccaccaccatttttttttccttaataaaaaggttggggatctgccctgccgcgggtgggagttcttacccggacgtggatatcacaattcctccacagggggccttgtgggtaaaattgtggccaaactgggggccaacaaaatcccccacccc

SEQ ID NO: 1988 - DNA, 253 bp, Homo sapiens
tttttttttgaattttaaagtttatttactttgaagtaaccaacttaaaaaatggcctgagttaagtgtattaaaaagaagaaatagtcgtaagatggcagtataaattcatctctgcatgtagaaaccggaaaaaaagcaagttcagtacttcaccaaaaaatttcaacattgcaaacacaggaaattgagaactgacaaacagaaatactaggaaatgcaaagtcttgaagctccaaaacaaaaacagcaa

SEQ ID NO: 1989 - DNA, 565 bp, Homo sapiens
ccgcctggtgcagtaccgcggcgaggtgcaggccatgctcggccagagaccgaggagctgcgggtgcgcctcgcctcccacctgcgcactgcgtgcgggccgccactgtgggctccctggccggccagccgctacaggagcggcccaggctggggcgagcggctgcgcccggtatggaggagatgggcagccggacccgcgaccgcctggacgaggtgaaggagcaggtggcggaggtgcgcgccaagcatggaggagcaggcccagcagatacgcctgcaggccgaggccttccaggcacgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgttcccgccccagccgtcctcctggggtggaccctagtttaataaagattcaccaagtttcacgc

SEQ ID NO: 1990 - DNA, 625 bp, Homo sapiens
ttcggcacgaggcacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcg

SEQ ID NO: 1991 - DNA, 160 bp, Homo sapiens; identical to SEQ ID NO: 1119

SEQ ID NO: 1992 - DNA, 339 bp, Homo sapiens; identical to SEQ ID NO: 274

SEQ ID NO: 1993 - DNA, 146 bp, Homo sapiens
gagaagacgacagaagggaagtagacattgaatgcttatggctcctgattctgaaggagctggctgtaaagaggcttgggcggatgtgctttgaagttatggatattacatatctcacgaaaaaatattaaaataaacagtgctgg

SEQ ID NO: 1994 - DNA, 403 bp, Homo sapiens
cacggcggcagccctttaaacccctcacccagccagcgccccatcctgtctgtccgaacccagacacaagtcttcactccttcctgcgagccctgaggaagccttctttccccagacatggccaacaagggtccttcctatggcatgagccgcgaagtgcagtccaaaatcgacaagaagtatgacgaggagctggacgagcggctggtggagtggatcatagtgcactgtggccctgatgtgggccgcccagaccgtgggcgcttgggcttccaggtctggctgaagaatggcgtgattctgatcaagctggtgaacagcctgtaccctgatggctccaagccggtgaaggtgcccgagaacccaccctccatggtcttcaagcagatggagcaggtggctc

SEQ ID NO: 1995 - DNA, 591 bp, Homo sapiens
  misc_feature 470: n = A,T,C or G
ggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctcccgcccggcgcccncagtgttttctgagggcggaaatggccaattcgggcctgcagttgctgggcttctccatggccctgctgggctgggtgggtctggtggcctgcaccgccatcccgcagtggcagatgagct

SEQ ID NO: 1996 - DNA, 467 bp, Homo sapiens
gagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaagatgggggcctatgtcttcatcggcgtgggggcagtcactatgctcatgggcttcctgggctgcatcggcgccgtcaacgaagcccgctgcctgctggggctgtactttgctttcctgctcctgatcctcattg

SEQ ID NO: 1997 - DNA, 503 bp, Homo sapiens
tcggcacgagtgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctc

SEQ ID NO: 1998 - DNA, 466 bp, Homo sapiens
ttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccacca

SEQ ID NO: 1999 - DNA, 574 bp, Homo sapiens
acagaaggggactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatatggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgc

SEQ ID NO: 2000 - DNA, 629 bp, Homo sapiens
gtgacgttcaactccgctctggcccagaagaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgat

SEQ ID NO: 2001 - DNA, 466 bp, Homo sapiens
agtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcactcctgaaaaagaaagaggtatgacatgtgcttgatggggctggcattggcggtagacactccttgaataatcttgattctggaatgttggtgccaaggtgaaacatgccactaaatctgaatcgtcattttcctaagagaagcatattatgtcggagcggaatgttctgttgaagaatgtgaatcaccctttcctggtgggccttcacttctctttccagactgctgac

SEQ ID NO: 2002 - DNA, 508 bp, Homo sapiens
tggatcccccgggctgcaggaattcggcacgaggagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcgga

SEQ ID NO: 2003 - DNA, 253 bp, Homo sapiens
gagtgtcacaggggaactttattgagaggaaacatggtcacacccagcagacatgctttccctcaatctcggtcttgcactggcgcgcgcgacacacacacacacacacacacacacacacacacacccatctccagcccctgccactgtccagttctcagccacaaggggggacactcctcaattcctacgatcagaggcagcaggggcaggagggaggcaagaggaggggagaagtagcctggtcctgggg

SEQ ID NO: 2004 - DNA, 438 bp, Homo sapiens
tagtggatcccccgggctgcaggaattcggcacgagcacagatcagcatgggaacaggggtcacagtggacacaagggtgggctgtctctccacctcctcacattatgctaacagggacgcagacacattcaggtgcctttgcagaaagagatgccagaggctcttgaagtcacaaaggggaggcgtgaagaaatcctgcatctcggtccctcacaagacagctgtctcaggcttttcaagctgtgagagacacatcagaaccctgggcactgtcgctggacgcagcctgagagtagctccctccttttccacctgagctcttcctcctacacatcacagtagcgaccacagctccgatgaccacaactgctaggacagccaggccagcaacaatgcccacgatggggatggtggactgggaagatggctcccatctc

SEQ ID NO: 2005 - DNA, 509 bp, Homo sapiens
ctgctaaggtgcatttattgaaaacagtgtatgctatgcactctgttaagtgctatgcatctattagttaatcttttcctcatcagacttttacgaggtaggtaaggtatagcatttccatcttatgaagaaactgaagttcgaagagatgaagtcacctgcccagcactgcaaactagtaagtgatagagcctggattcggtctgtgttctgaccactctcttgctccatctctttaaagagagtgaaaagggggtgaagatacctgctctattgcccagtaatggataggccgagcagtgggggatgggaggaaggaaaggagaaatggctgctttcatcggaggatcgtcctctgctactgactgcccacagctggtggtgctggggctgaggagccaaattcagttcctcactccggtgaccctctggatccagtccttgttgtggtggatgtaagagtatactccgtagcggtccttcttcccacagtcatcaccccaggacac

SEQ ID NO: 2006 - DNA, 374 bp, Homo sapiens
tggatcccccgggctgcaggaattcggcacgagggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttg

SEQ ID NO: 2007 - DNA, 511 bp, Homo sapiens
ggattgcaaaatttattaaaattggagacactgttttaatcttcttgtgccatgagactccatcaggcagtctacaaagaccactgggaggctgaggatcacttgagaccagaagtttgaaggctgtagtaagcttcaaaggccactgcactctaacatgagagaagaaaaaccatacaaacaaaagaagaaagaaagaaaaaaaaagacaaaaaaaacctagaaaaagataacaagactgcctacaatacaacaaacaagaaaacagagaccaaagaaacaaaaaaacatacaccacacaataaagaagagacaacacaccaaaccgaaacaaaacaaccaaagaaaaaaacaaaaccaagagaaaaacgaaaaaacaaaaccaaacagaaaaacaccacgaaaacataaccaaaaacaagacaaaagcaaaaaaccaaggcaagagaaaggcaagcacaataggactacagaaatcaaatcaaccttcctatgaggaaacacatgtcca

SEQ ID NO: 2008 - DNA, 563 bp, Homo sapiens
tggatcccccgggctgcaggctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgaactggaggtgaagatccgtgactggtaccagatgcaggccccggggcccgcccgtgactacagccagtactacaagacaattgatgagctgcagaacaagatcctcacagccaccgtggacaatgccaacatcctgctacagattgacaatgcccgtctggctgctgatgacttccgca

SEQ ID NO: 2009 - DNA, 510 bp, Homo sapiens
tcggcacgagggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagc

SEQ ID NO: 2010 - DNA, 435 bp, Homo sapiens
  misc_feature 2, 3, 20, 25, 69, 365, 393, 426, 431: n = A,T,C or G
annttcaagcatttgtttcntcttncccacgccattgaagaggctgacgattataataattacaatganttacagaaggaggtgggatctcagtcctccagggtcagggactcttaaactacctcctttctctctttgctcagctctgccccatacccctgtctcagtgtttcttcctttcctcaaaatcctcaacagagaggccagagctgggcaggtgtggggtatgggttagccagaggtgtgctggggtcaggccacctcgccggtggaattccgccttttctcacacacccagcggtacacctgcaggcagaagtcatcgttccagcggccatccggctggacttcaacacagttttcanttccacccagctcgtgcccgtgccaatnatctggttgagtgacagcccagtttcgtgtagntggtngccc

SEQ ID NO: 2011 - DNA, 443 bp, Homo sapiens
tcggcacgaggtttttttttttttttttatgggccttttggggggataatgacctacccttggccggggcccaaaccttttgaaaaatgtttgattccaggctaaaaaccatttttaaacaaaattggttttttgcaccccccacaaacccccaggaaaagggcccctccggggccttccccacccaggccaacaaagcgttgggggcccgttaaaccgtcccaggcattcctttgatgacccaacccccccccccttttgggcccaaaccaggacaaataaattttcaacaggggcctgccttgtaaccaaaaattactcattttcacaccccctgaatgcaaggaaagggggcccccccaaaaccaacttgccccccaaggggggtccccccacggttctggaaaatgcttccctcaggtatttcacaggggcaatccccc

SEQ ID NO: 2012 - DNA, 622 bp, Homo sapiens
  misc_feature 587, 608, 619: n = A,T,C or G
ttttttaaaatcacaaatagttatttattagtcatcagtgaatggaaatgaatgcacatcaacttttttatttattggaaacaaacactcaatatcctgtaaaactaagaaaacaggtatttttgctaagtaatgtatctttaaaagtaaaaagtgtgtatattctctctgatatttagaataatgcaattgtacaggatcctttcccaaattattcttttctctaaaatgacagctagaaaggaaccctttgttctgtcttgccgttggtcattttagatgtcttttcttcaatggagtgaatccttgatgaaagaactttaccacgttgatctagctcttcaaccactgtctttaccagtgtggttttggataaatctttagatgaattcccagggcttcctgatccaaagccctttgatttggagcatgaatttccatctccatctatcaggcggcagtaggtctcaatttctttttccaagtggaccttgacatcgaggagatgctcatactccagcttctggcctcggctcgggtctgactggtgaagtgtcctccagggcccgtctgagcctgattggcanggcgtacagaagtgccccggnttggtaagganctc

SEQ ID NO: 2013 - DNA, 387 bp, Homo sapiens
tcggcacgaggtttttttttttttttttatgggcctttttgggggataatgacctacccttggccggggcccaaaccttttgaaaaatgtctgattccaggctaaaaaccatttctaaacaaaactggttttttgcaccccccacaaacccccaggaaaagggcccttccggggccttccccacccaggccaacacagcgctgggggcccgttaaaccgtcccaggcattcctttgataacccaaaccacccccccttttgggcccaaaccaggacaaataaattttcaacagggccctgccctgtaaccaaaaattactcactttcacaccccctgaatgcaaggaaagggggtccccccaaaaccaacatgccccccaagggggg

SEQ ID NO: 2014 - DNA, 563 bp, Homo sapiens
  misc_feature 134: n = A,T,C or G
cggcacgaggcccatacccgctgcaggcagcagcagcccccgcccgcgcagcagcatggagctctggggggcctacctcctcctctgcctcttctccctcctgacccatgtcaccaccgagccaccaacccagnaagcccaagaagattgtaaatgccaagaaagatgatgtgaacacaaagatgtttgaggagctcaagagccgtctggacaccctggcccatgaggtggccctgctgaaggagcatcaggccctgcacacggtctgcctgaaggggaccaatgtgcacatgaaatgctttctggccttcacccagacgaagaccttccacgaggccagcgaggactgcatctcgcgcgggggcaccctgagcacccctcagactggctcggagaacgacgccctgtatgagtacctgcgccagagcgtgggcaacgaggccgagatctggctgggcctcaacgacatggcggccgaaggcacctgggtggacatgaccggcgcccgcatcgcctacaagaactgggagactgagatcaccgcgcaacccgatggcggcaag

SEQ ID NO: 2015 - DNA, 459 bp, Homo sapiens; identical to SEQ ID NO: 1664
  misc_feature 219, 289, 318, 422, 442: n = A,T,C or G

SEQ ID NO: 2016 - DNA, 356 bp, Homo sapiens
  misc_feature 259, 293: n = A,T,C or G
caccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtggcaacctgggagacactcatcctgggactccaacccgctggcctgcgactgtcggctcctgtggggtgttccgggcgccgtggncttccagactttcaaccgggcagcagcccacgtncgccacgcccgagtttgtccagggggcaagggagtttcaaagggatttccctggatgttgtta

SEQ ID NO: 2017 - DNA, 502 bp, Homo sapiens
cggcacgagggaaagggactttgaggcgggtgtttttgaactaaaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttct

SEQ ID NO: 2018 - DNA, 231 bp, Homo sapiens
  misc_feature 95: n = A,T,C or G
agatctcagtggaaagcccaacagtaacaggtgcacccacgggctccaggggaaggggccccaacccctggtgaaggaggtcggggcagagcagnctcccccagctggggttgcaggggtgaggggagacccccctgtaggcccgtcctgcggggctaaggagggggcacgggggtgggacaggttgggggtggggggcaggccagggaaatggaggaactcgggccaagt

SEQ ID NO: 2019 - DNA, 376 bp, Homo sapiens
  misc_feature 106, 320, 360: n = A,T,C or G
gattcggaacgagggattggctgcaaccatcccctaccaggacccggcccctacaggtgaagttcctggtgatgaatgacaaaggacccgtggctgaaaccaagtngtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacacnacgtaccttcgcgtttagcacttcctgccgagggggcttnctgaggggtttcagag

SEQ ID NO: 2020 - DNA, 422 bp, Homo sapiens
  misc_feature 380, 395, 409: n = A,T,C or G
ctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctggggccggttctgccagggagcaggggatcccgttcccacccatcttcgcccagccccgaagaggcagctccagccttggggagttgccacactttttncggaccccacctggncccgggagccctgngggtggtggcatt

SEQ ID NO: 2021 - DNA, 431 bp, Homo sapiens
attcggcacgcagggaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaatagagttataaaattgc

SEQ ID NO: 2022 - DNA, 309 bp, Homo sapiens
gcaaagggaactttattgagggaaaaagaaaagggggggcccccaaggcccccccccccttaaaggggtcaaaatggaaactggaagggggggaaattcaatgtggggggggactgagtggggaagggaccccccaaaaaggagggtcccccccttccccttgggcccttgcgggggcggggggcccaggggtctaaccccttggaggccaagggggccaagagggccaccaccccgttggtgtagcaaaaatcggtgtcaaaccagaaaaaaaggctaaaaaagggggtcttgggggcaatgcacccc

SEQ ID NO: 2023 - DNA, 454 bp, Homo sapiens
  misc_feature 393: n = A,T,C or G
accgcctggactgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccangggcccctttacatgccctctcccttttataaaattttccattaaaaaccacctattttct

SEQ ID NO: 2024 - DNA, 404 bp, Homo sapiens
ggcgagtgcctgccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcacgatcctcagccggctggcagcaagggcacggagcctcaccccacaccggcctacccgccgtgtccctacgctacacctccggggtacggggcggccttcagcgcgacccgtagggcacctggcgccgcacgcaattacagccagatgcctgcagggtccttcatcaagccgcacaacggcctcagtgcttgtgaaaagagaagaa

SEQ ID NO: 2025 - DNA, 574 bp, Homo sapiens
  misc_feature 388: n = A,T,C or G
tcggcacgaggctgagaactcaagtcagctggacttcgaagagtatggaattcttcctatggtgtgaatgattccttcccagatggagactatgatgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcancctttgcccaggctttgctgctagggtgccatgcctccctgggccacagactgggtgcaggccatgtcccatgcctcaccctggggctcactgtgggaatttggggagtggctgccctactgacactgcctgtcaccctggccagtggtgcttctggtggactctgcaccctgatatacagcacgg

SEQ ID NO: 2026 - DNA, 515 bp, Homo sapiens
caaggatcccatcttgcacgtgctgcggagtacctggatccggcccagcgtggcgtccgcgtcctcgaggtggcctcgggctccggccagcacgcagcgcacttcgccggggccttccccctggccgagtggcagccgtcggacgtggaccagcgctgcctggacagcatcgcggccaccacgcaagcccagggcctgaccaacgtgaaggcccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagt

SEQ ID NO: 2027 - DNA, 533 bp, Homo sapiens
tcggcacgagggcgtcgctccccctcgccttctcggccgccctcccggtttaccgccccctgtgtccagagatcacagatggagagacattttgccacacgatgaatcacacaccacatctcatcctcgagcttcagctgcaggacaatgctgccagaggcctggtcctcagagctcacgtaagcatctctggtgtgcagtatttttactccgtttttgaccaaagacacctgaacattcctggagaaaacagtgatgtggatcttatcaaatttaatgggcacatctgaagaaggaaacttgctcagcaccgtgagccccacagtgaaagcactttttggcaagactagagtctcaccgatttttcctttctctcctcgatctcctttccagcctcttattccccggactcctggctcaccctggggccccgtgggtccagcttctcccttgggaccaggctttccaatagggcccatggggcccggtaaaccagttgggcccaaaggcccaatgttgccccttggcccctc

SEQ ID NO: 2028 - DNA, 618 bp, Homo sapiens
  misc_feature 85, 515: n = A,T,C or G
tcggcacgaggggccatccaagatggcatgaatcgggctaaggtccctgggggtgcagatggtactgctgaggtcccgggcttantgtgagcatcttgccagcctcaggcttgagggagggctgggctagaaagaccactggcagaaacaggaggctccggccccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccanaaagctgtcagagccggccgccttctcccctctcccagggatgctctttgtaaatatcggatgggtgtgggagtgaggggttacctccctcgccccaaggttc

SEQ ID NO: 2029 - DNA, 556 bp, Homo sapiens
  misc_feature 366, 416, 461: n = A,T,C or G
cggcacgaggtctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccangctgcctgagcacctcccagcccctgcccctcatgccaaccccgccctangcctggcatggcacctgtcgcccagtgccctggggctgatctcanggaagcccagctccagggccagatgagcagaagctctcgatggacaatgaacggccttgctgggggccgccctgtaccctctttcacctttccct

SEQ ID NO: 2030 - DNA, 460 bp, Homo sapiens
  misc_feature 385: n = A,T,C or G
gtggcggaggccagccccgagcttgcccagcggtgcttcaggcagggaggggccaggcccgccagccaggcgaaggcgcaggcagcgcgcgcggggcgccgtaggcaccgggccaggcgggcagccgccctgggcccgggaccgcgtacgaagccgcagcggcacacgctgatgagcgcggcgaagaccaccgccgcataggtggacacgtagtaggtggccccggccgcgtggcaggcggcctccgggccaggcccaggtagtaggtgagccacagctgcagcgtgagcgtgaagaactcatcaaccagagccaggttgaacaggtagagaagcagggcctggcccaggcgcccgccgctgcggatgaacattgccagggccgncacgttggctggcagccccaggcccagtgccaaggcataggccgcgggcaccacgatgaagcgagcagggtcatc

SEQ ID NO: 2031 - DNA, 508 bp, Homo sapiens
  misc_feature 387: n = A,T,C or G
tcggcacgaggtcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctatgttggagtccagcctaatcaagtcaaatggagaaacaggcccagagaggaaggtggcttaccaagatcacataccanagtctggagctgagctacctggggtgggggccaagtcacaggttggccagaaaaccctggtaagtaatgagggctgagtttgcacagtggtctggaatggactgggtgccacggtggactt

SEQ ID NO: 2032 - DNA, 475 bp, Homo sapiens
atgtttccaaatttacttgattttcaagacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggttttatagaaaaataattatctaacttggtttatattgacaggttgttttcttggataagaactagacgaagagaaagggagattagtgataaatgtccaggttttcaagttgaaaagtaacaatcagtgtattacaacagatggatgtgatgtcaaattacaaatgctgaaaacgttatatgtaatcatgtagccagagtaatcatacaaggcaaagaacggaaaggca

SEQ ID NO: 2033 - DNA, 204 bp, Homo sapiens
gatatgggttagggattctccatggactccagaaaccctaaaatacaattttgaggttttccaataataccatagcagaaatgtccaaggggttgggggaagatattaccttgagaaaacagaaatgtaaaggatttttgaccttatatatgtgtgtggttttgtttttgtttttgttcttgagagagtctcactctgtcaccc

SEQ ID NO: 2034 - DNA, 271 bp, Homo sapiens
gggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgtt

SEQ ID NO: 2035 - DNA, 500 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggaaagaggggtgggatccacactgagagagtggagagtgacatgtgctggacactgtccatgaagcactgagcagaagctggaggcacaacgcaccagacactcacagcaaggatggagctg

SEQ ID NO: 2036 - DNA, 415 bp, Homo sapiens
agctgattttcatgaaaatctgccactcagggtctgggatgaaggcttgccagcacttccagtttagaacgcaatgtttctagagacatattggctgtttgttttgatgataaaggagaataagattttgtgtgggtttcctggatccaggataatttttaaaccaatcaaatgaaagaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctca

SEQ ID NO: 2037 - DNA, 378 bp, Homo sapiens
gattattcctcacgatgacccgacagtctctgctttctttttcctttcttccagaaggagatttaaccatagtagaaagaatggagaactattaactgcctttcttctgtgggctgtgattttcagaggggaatgctaagaggtgagtgggggaagtcgattagagcctggttcacaatgcctgggaggacaggggctgaatcgctgagagtggtgagtgggcatgcagggagagtactcacccagagaaaggggtgtgtgcctgagggggtgcgcacgcacacatgtggacacatggaaaggggagaagtagtgcaaagaataaaggcctgcagagtttgggatttggtgaagaaatagtctaattgcatgttctta

SEQ ID NO: 2038 - DNA, 391 bp, Homo sapiens
gagccgccgcctgccctctccgctggccacctgctgccgcccgctccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccg

SEQ ID NO: 2039 - DNA, 571 bp, Homo sapiens
gacagaggggcctttcctttcagcggagcgcggcggtaagatggcagtgcaaatatccaagaagaggaagtttgtcgctgatggcatcttcaaagctgaactgaatgagtttcttactcgggagctggctgaagatggctactctggatttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctc

SEQ ID NO: 2040 - DNA, 571 bp, Homo sapiens
cggcctacgctgcaagaagagacagaggggagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcgccttctttttcaacttcaaagtggcacaaacactgtgctttccatcttagaaatctgattgttctgtcagaatttatatttacaggtttcaaagca

SEQ ID NO: 2041 - DNA, 338 bp, Homo sapiens
gaaagtaggcagggctgtgttcctttgtgtagtctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttgga

SEQ ID NO: 2042 - DNA, 551 bp, Homo sapiens
gtcaaactatacagctgtctgtcctacagttttttattatggtgtagctgtatttaaatacaaagagggccaggtgcagtggctcacacctgtaatcccagcagtttaggaggccaaggcaggggatcacttgaggtcaggagttcaagaccaccttggccaacatgatgaaaccccatctctactaaaaatacaaaaattagctgggcatgatggcacaagcctgttatcccagctacttgggaggctgagacaggagaatcacttgaaccctggaggtggaggttgcagtgagccgagattttgccattgcactctagcctggacaacagagcgagacttcatctcaaaataaataagtaaataataaaaataaaaagagatctaattgcatctgtcttttaaaattgacttatcttttaagttatttgacatgttttatagtttttataaaagtcgtaggaataggaaaaggatttacatatatcccttttcgcatctgaaagctgactaaataaccagtattacaggctggtcatagtggctcacgc

SEQ ID NO: 2043 - DNA, 506 bp, Homo sapiens
agttaaaaacatgccattttcatttctaacattttaagtatatggtttagaagtggtaagtatagttctatttttttttgcaataggttttaaataatttttgtcttacaaaagtaaaagtgaatactcattaattctgaaacaagttagttagcttgctttatttaaatagcaagaaaagggtccctggaaagtccctggcccttgggtcagtgtctcatccctgcataatataaaaggaatcctggaaaaaatcaagctgcagacactaacaaggtaactagcacatggtgttgtgcttggaaacctgcccatggctgcacagacagaaaaacctctggcatatttggataaaaacttgtacaaacctccagctcactgagataagggaacaagaccgacctggcataaaaatgcctttgtttgtccaggcacagtggctcatgcccgtaattccagcaatttgggaggcagaagtgggcggatcacctgaggtcgggagttcg

SEQ ID NO: 2044 - DNA, 660 bp, Homo sapiens
acctgcccaaagcataatgcgaagcaaggtccagctgttccgcccgtcatacaagcttatggagcagccccctttgaagatgtccaggtggacttcacagagatgccaaagtgtggaggtaatcgagtgtggatcaaggactggaacgtaacttctttgtgcccacggtggaaagaccgtagtctgtcgtcctgaccactcccaccgctgtgaaggtagagggaatcccagcctggatccaccacagccgtgtaaaacctgcagcacctgaaacctgggaggcaagaccaagcccagacgacccttgcagagtgaccctgaggaagacgacaagccctgctccagtcacacccagaagctgactggtccacgcacggccgaagcatgaggaagctcatcgtgggattcatttttcttaaattctggacttacacagtaagggcttcaactgaccttactcaaactggggactgttcccagtgtattcatcaggtcactgaggtaggacagcaaattaaaacaatctttctgttctatagttattatgaatatatgggaatgttaaaagaaacttgtttgtataatgccactcagtacaaggtatgtagcctgggaaatgaccgacctgatgtgtgttataacccatctgagccccctgca

SEQ ID NO: 2045 - DNA, 495 bp, Homo sapiens
atttggttaatggctccgttttcagcattgcaaataacaatctcagctactgggatgcccccctgggaagttcttatatgtgcaacaaagagcagactgtttcagtgtctggagcatttcagataaatacctttgatctaagggtccagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatc

SEQ ID NO: 2046 - DNA, 451 bp, Homo sapiens
atggaagcattagagagaaagagagaatttccaatctatgggtatcataggtggtttcttggaggaaagtggaactgaactaagcctcgaagttggtaaggaacagatggttggctatggtagggtggagaaaagcagagttgcagaattctcttatgttgtagtcccaaattaatagtaatgtactagattttcttctcctctcttgtgaatttccagcaacagcttgattttaacctccacagaaacacaaatgagagctgtgatggaaacaataattactagagtccagttttaactccaagtcaaaattttagtcacattcagccctgaataagaaataaggcaaagcatgcaacaggactttataactttttaattttaaggcattataaatataaatttttattttatcttatttttttagagatggggtcttgctctgttgccc

SEQ ID NO: 2047 - DNA, 292 bp, Homo sapiens
gattagggggctaagcatttagttactgcatggggcagccaataataaaatcacagccctgtgtatttacctccacagtgtgtgctgataagtgcaaaaggtttgtgcaaattcttttgaagttatattgtaaccatggtatatgtattgaaaacttggccattttaccccattcctatgaatgaaaactatttggtgaatcagaggatagtctgaattgggatatgaaggccagtataagtgtcagttagcaaagtcagctctagtttagttttttttttttttttttaag

SEQ ID NO: 2048 - DNA, 487 bp, Homo sapiens
tactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatacgtaccacatgaaggaagatggttgggtgaaagtagaaagtacagatgtcagtggcctgctgcaccagtaccgggaagccaatcaataatggtggtggtggcagctgggcaggtctcctc

SEQ ID NO: 2049 - DNA, 500 bp, Homo sapiens
agattttaattccacacatatactgtatatctctttatgtactatatgtatatctgtactttgtacataaaaaggctaagtatagagcttactgtttttattcaatacaggctcaagaagagccgaataaagcggggaagctgaaaattaaattaaaaattaaagacctattaataccaaatttagctttgcacctatacttgctgaataacttttcatgtaatttatttacttatatatatatatatatatatcatcacaatgtgtcaatttacatacataaattagcaattcataaaaaacaacagcaatataataaattcttataaaatcatttaaaacttatttttttcagaaaaaaattttaaaaacttctttaaaaatattcttagagaacttttaaaactttttgctagatatgagagaacaatttttaatttaaccagctaatagatgtacattcagatattgacattttttcctttcagcgcttgatataa

SEQ ID NO: 2050 - DNA, 429 bp, Homo sapiens
ggaactcctctgaccctttagaacaagcctacctaatatctgctagagaaaagaccaacaacggcctcaaaggatctcttaccatgaaggtctcagctaattcttggctaagatgtgggttccacattaggttctgaatatggggggaagggtcaatttgctcattttgtgtgtggataaagtcaggatgcccaggggccagagcagggggctgctgctttgggaacaatggctgagcatataaccataggtatgggaacaaaaaacatcaaagtcactgtatcaattgccatgaagacttgagggacctgaatctaccgattcatcttaaggcagcaggaccagtttgagtggcaacaatgcagcagcagaatcaatggaaacaacagaatgattgcaatgtccttttttttttctcctccttctgac

SEQ ID NO: 2051 - DNA, 196 bp, Homo sapiens
aaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttcttt

SEQ ID NO: 2052 - DNA, 593 bp, Homo sapiens
aggattaactttttttttaacctggaagaattcaatgttacatgcagctatgggaatttaattacatattttgttttccagtgcaaagatgactaagtcctttatccctcccctttgtttgattttttttccagtataaagttaaaatgcttagccttgtactgaggctgtatacagccacagcctctccccatccctccagccttatctgtcatcaccatcaacccctcccatgcacctaaacaaaatctaacttgtaattccttgaacatgtcaggcatacattattccttctgcctgagaagctcttccttgtctcttaaatctagaatgatgtaaagttttgaataagttgactatcttacttcatgcaaagaagggacacatatgagattcatcatcacatgagacagcaaatactaaaagtgtaatttgattataagagtttagataaatatatgaaatgcaagagccacagagggaatgtttatggggcacgtttgtaagcctgggatgtgaagcaaaggcagggaacctcatagtatcttatataatatacttcatttctctatctctatcacaatatccaacaa

SEQ ID NO: 2053 - DNA, 76 bp, Homo sapiens
agaccacacaagggtacggctgcgagaagacgacataagggtaccgctgctagaagacgacagacgggtctggctg

SEQ ID NO: 2054 - DNA, 503 bp, Homo sapiens
acagaagggtacatgaaggaaaactgatttggtggaaagataataaaaataaaacatgggaaatggggaaggtgataacgtgggggagaggttttgcttgtgtttcaccaggagaaaatcagcttcctgtttggatacccactagacatttaaagttctacaatgaactcactggagatgcaaagaaaagtgtggagatggagacaccccaatcgactcgccagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccagccctgtgctcacggaaacatgtgctgtaaggtttaagggatctagggctgt

SEQ ID NO: 2055 - DNA, 512 bp, Homo sapiens
ggaacagtgtggcccgccatgttcttctccgcggcgctccgggcccgggcggctggcctcaccgcccactggggaagacatgtaaggaatttgcataagacagttatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgt

SEQ ID NO: 2056 - DNA, 457 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatg

SEQ ID NO: 2057 - DNA, 501 bp, Homo sapiens
gctttttcgaggtaggagtcgactcctgtgaggtatggtgctgggtgcagatgcagtgtggctctggatagcaccttatggacagttgtgtccccaaggaaggatgagaatagctactgaagcttataggtttgtttcttcccaggtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcaccca

SEQ ID NO: 2058 - DNA, 540 bp, Homo sapiens
gacagaaggggtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaatgatgaaatttcattctgattttctggctgaagactattctc

SEQ ID NO: 2059 - DNA, 540 bp, Homo sapiens
gaaatgtcaggtacgtcttcattgattttacatcccagcacctagcagcacatatgacagaacaggtgaggtgctcaaaaagaattttttgtttcgaccatctataaagttgaatgtaagaggccatggaatgacctgtttgttcatctcattgattcattaagacatggaatgtaaaaggccatggaatgaccatctactgaaactaaaattagacattttaccataattatttttaaaccactataagtagatattggttaaaaactttattattgataaactcatgctgggtgagttttttaaaaactttctttcataaagtcacaagaaaaattgctatatttgaagatcttcattgtatatttatacaagttagcaaatgctgcctaacaaaccacctcaaaggtaattgcctaaaacaacacacgttattactcttgagtttgtgtatcagcagaatgactcctcctgtctcagtttgccttcattgtgtatctggagtcagctgtgcatcagtcagtcaactctgttgactgc

SEQ ID NO: 2060 - DNA, 470 bp, Homo sapiens
aatcagtttttttttatctagagaagatagatttgcttgagtcctaccacactcacatacttttgtgagatggctgcttatggaaaggatattgtttttctttgggacagttatgatcttggcctctgatactaggatctaataaagcaagctgactagaaaagtaaaagcagtagttctgtgtaatgtgtgagctgtgaatttgttgctttcaagctgtttgttgtgttgtggcctgttctagtggactgggatcctgaggttttataacttaattttattgtagtagtaggcaaaatgctctttgtacctcagtttcctttcctgctctgtttcctcttttgagaagataaatgtgtacacgttaattctcccagtttcataacatgatggtgaaagaaaatactgtaaccaggggtgttttttaaaaaatgaagtgcaaggttgatagcaatttttgcatataaatg

SEQ ID NO: 2061 - DNA, 478 bp, Homo sapiens
atattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaaaaaaaccctttgaatttccagggccccttttaaaaattttcccttcaaaatttgggggtttggattcccaggttggaattttccaatggtaatggaaaacaaactgggcccccccccttaaaaaaaagggaattttttatccctttggggggccatacccgccgtttttttttttttttttttgggggaatttttttaaaaaaaaaaaaa

SEQ ID NO: 2062 - DNA, 194 bp, Homo sapiens
gtcgcggcgacatggccaaacgtaccaagaaagtcgggatcgtcggtaaatacgggacccgctatggggcctccctccggaaaatggtgaataaaattgaaatcagccagcacgccaagtacacttgctctttctgtggcaaaaccaagatgaagagacgagctgtggggatctggcactgtggttcctgcatg

SEQ ID NO: 2063 - DNA, 497 bp, Homo sapiens
catgctgggaggaatgttttcgggtcatacggagtgtgctggagaagtgtttgagaggaacggacggaagctcaagctcttctacgggatgagctctgacaccgccatgaacaagcacgcaggaggagttgctgagtacagagcctctgagggtaagactgtggaagttccttacaaaggagatgtggaaaacactatcttggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttctcg

SEQ ID NO: 2064 - DNA, 556 bp, Homo sapiens
tacggctgcgagaagacgacagaagggtacggctgcgagaagacgacagaagggtacggctgcgagaagacgacagaaggggtggagaatgaattaggatggctgaaagagtgaacactgatttaccaaataggaagttctcacagtagttgaaacacaagttatggtggctaggactgggaggggactatgaagataaaaaaaagcggtctattttgaaatagaaggggatatgttttgaaaatagagaaacaaaagtgactatgaagtaggttgataaattctgccgctagcaaaagcagagaaaattacaaagagggaatggttaaaaatgaagttgaattcattttaatatgatagaggctggggaaggatggctagaagagaagtagaagtcagttggggagtgttcaaggcagggaacagttttatgcagagatcctaagcctatgccttcagggacagcaagaaggcccttgtaacatgtacaagtttagccttgtacatgttaaatttgagggaaaaaaaatgcaaattagttatttctaccaagggc

SEQ ID NO: 2065 - DNA, 427 bp, Homo sapiens
gtctctcttccttctccctcactccacacacacatatagacgtacatatattctacatgtatatgtattttgtatatatatatatatattttaactctagcttttttccaaatctttctctgcctactgatttttagtatgtgtgatctatcattttctaatatagattattctcatattaacttctcctattatgattggagattgtgaaattctcctaataattttgtccttttttactctttgtattttgaggccatgttgttgagtgtatgcaagtgtatatttgttacaatttcttggtgattgtcccattaattattgggtagttcctttactctgcctgttagagtgttttgccttattttttttccatcctacagctattaaaatacacgcccggcatggtggcttatgcctgtaatcc

SEQ ID NO: 2066 - DNA, 226 bp, Homo sapiens
aagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttggg

SEQ ID NO: 2067 - DNA, 420 bp, Homo sapiens
tattttataaggctgagtacatatacagatgatcccattttagtttctcagctattttactatatgttaaatattttgatgctgtatttacatattagcatcagcaaccataatttttctgataacttttcaagatcagccaaatcatgtggtggacaagtcacactttttctctgaagttttccataaaacccaaattaaaagtgatctgacactggtagcattttacaaatctaccttcatttagcatttatatatgcttttaagttgaagttttttctatatatgaaactgcaagtggttaaagggcaggttttgtgttttaggtttggtaatttctctcccaaccagtgtcagattggctcagtctgagtggaggatcaatgaataggtgatgaatgaatggatatctacatgtca

SEQ ID NO: 2068 - DNA, 403 bp, Homo sapiens
ggcggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataatagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaagaatctcttctcgattaaaatacacacatcttaagaataaagtttcggagcatat

SEQ ID NO: 2069 - DNA, 498 bp, Homo sapiens
tacggctgcgagaagacgacagaagggtacggctgcgagaagacgacagaagggtacggctgcgagaagacgacagaagggtacggctgcgagaagacgacagaagggatgacaatagtggtgctataaacccaaggacattgttatgagttttcacattaaaaaaatggctggaaacttagatttaattaagggcacacaattatggcaagaggggtgtagctgaaaaccatagagagtgagaaatacaggcagtaagattctcagagccatgtttgcgtatctacattgcctgtactttatggaattctggttcttggtgatatttggagttcagatagtggatttatagtgggaaagaggattttgaatatagagatagtagaactagggaatgattttttaaaaataaaaggtaaagaacagaataggccgggtgcagtggctcatggcctatatcccagtgctttgggaggcccaagagggggaattgcttga

SEQ ID NO: 2070 - DNA, 571 bp, Homo sapiens
gatgtgcatgccgaacctcccattctgtcgtcttgcttatgttactctcctttatgtttcactttctcaaatgaatgtcaagctggtgatttttagattcaaaaattctaaaataaattgctcaaatttccacattatgtaagctattaataaaatgtcttgtgggtgctacatatttattaaaatttttggttgtaattttaagctcactgcaggcagaaaggaatcattaacatttatattcttttttttagtctgtatctaaatgatggtatattttaattccagatattttctttatactgcagtaatgctcgtcatattttgcaaaatttatgttgttcttttatttggaaatataaggcttttttagctcctgaaatctatattatagtcatataattttattatgttttgtggtaagaagtgcagcaacatattgagaacataataaaattatcctgtatttttaatgattatttattaaattcctctcattagagcctgttattaatgattgtaatgtattttctgtataattttactgcaatttattaaattctaatgactt

SEQ ID NO: 2071 - DNA, 510 bp, Homo sapiens
gatcttgttaaaacagattattttatgtcatctcttcacttaagattctctgtgatgagttctttaccccactcagagtaaagtctaattagtgtaatactgtaccaggttctacagggtctggcctctcattccctctcagacttcatcttctatttgctctttctactcagttatggtcacactggcctctttgctgttcttgaccacacctgcacactcctgcacctgcacttttatacttcttgttgcctctgcttggattgctcttcccctgatgtagaactgtatgtgaacttagtctaagtaaaacaaaacaaatcctaacttaccctatttaatcatgcaatcttcctctttgagtctgtaacctgtatacctttttcatgttttattttttctccaagccaattgtttgtctgttattatgtttctacttcctgctaggacacgttttgtcttgtttcttgttgtattactagcacttaacacaatgtctgactcatagta

SEQ ID NO: 2072 - DNA, 472 bp, Homo sapiens
gagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactccgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatg

SEQ ID NO: 2073 - DNA, 116 bp, Homo sapiens
taagctcactgtaggcagaaaggaatcattaagatttctattcttttttagtctgtatctaaatgaccatatattttaattccaaatacttactttatacttcagtaatgctcatt

SEQ ID NO: 2074 - DNA, 51 bp, Homo sapiens
tttgaagatgccccatttggattggatgaattccaaattctgctcgcttgc

SEQ ID NO: 2075 - DNA, 391 bp, Homo sapiens
gtcatttttgtgaagatttattccacattcaccatcctttttttgtgaaatttaaatcagatgtcataaagtctttaaaaagcagaattactttgaaaataaaggtattattattatagaattttagagattaaagaaaaaacagaaactaacatttaatgaagacctactctgtgccatgccatgtgcttagaactttgtttaagccatttcatttaataacctttcaacctaatgaagcaatatagcatgatggttaaactctgtgggctataggctgtcaagttcagctgcacagcggctaactagctttatgacttttcaaatgtttatcttctttttggcttagtttctctgttacaaagtggcaataataataatagcactcact

SEQ ID NO: 2076 - DNA, 192 bp, Homo sapiens
atattatctgtgtagtagcctgtttaaagtgatcattgctagtgcatggtatagaattacaaacttgtaaatacttctcaagattgccactttaaaaaaaaaagcaaaaagagctctgtagccctatttttttttttttttccaacaggaaatttgtttttgtttcaaaatgggggaacccccatttttttt

SEQ ID NO: 2077 - DNA, 474 bp, Homo sapiens
tacggctgcgagaagacgacagaagggtacggctgcgagaagacgacagaaggggattttcaagacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggttttatagaaaaataattatctaacttggtttatattgacaggttgttttcttggataagaactagacgaagagaaagggagattagtgataaatgtccaggttttcaagttgaaaagtaacaatcagtgtattacaacagatggatgtgatgtcaaattacaaatgctgaaaacgttatatgtaatcatgta

SEQ ID NO: 2078 - DNA, 197 bp, Homo sapiens
atcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttctttta

SEQ ID NO: 2079 - DNA, 79 bp, Homo sapiens
tgattaacattttatagaatgccccaggttgtttttgcatggattgttataagtcaggaggaaggagaagttgctcctt

SEQ ID NO: 2080 - DNA, 416 bp, Homo sapiens
gtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatc

SEQ ID NO: 2081 - DNA, 472 bp, Homo sapiens
atcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcg

SEQ ID NO: 2082 - DNA, 534 bp, Homo sapiens
tatggctgcgagaagacgacagaagggatctcttgcttggattattagtctctcaactggtctttctgtttccatccttcacaagagtgatcttgttaaaacagattattttatgtcatctcttcacttaagattctctgtgatgagttctttaccccactcagaagtaaagtctaattagtgtaatactgtaccaggttctacagggtctggcctctcattccctctcagaacttcatcttctatttgctctttctactcagttatggtcacactggcctctttgctgttcttgaccacacctgcacactcctgcacctgcacttttatacttcttgttgcctctgcttggattgctcttcccctgatgtagaactgtatgtgaacttagtctaagtaaaacaaaacaaatcctaacttaccctatttaatcatgcaatcttcctctttgagtctgtaacctgtatacctttttcatgttttattttttctccaaaccaattgtttgtctgttattatgtttctacttcctgc

SEQ ID NO: 2083 - DNA, 487 bp, Homo sapiens
gaaacttccaacagtactgtgaaaccaccaacttcagttgcctcagactccagtaatacaacgttcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatatattactcaagaagaggcattcggtatagaaccatagatgaacatgatgccatcatttaaggaaatccatggaccaaggatggaatacagattgatgctgccctatcaatta

SEQ ID NO: 2084 - DNA, 471 bp, Homo sapiens
gaaagaagtactttcagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccc

SEQ ID NO: 2085 - DNA, 377 bp, Homo sapiens
ggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtag

SEQ ID NO: 2086 - DNA, 441 bp, Homo sapiens
gcagaattcttagtgtgaaaggtgatgtaccacttcagatcagttttcactggagagacttgtaattggtagctgtagctcgtatccatccctagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggggtgggggggagcgctgaatttgtagcatttgctgcaaatataaattataaataaaattctaatataaattagaattttatatcaaattctttgatataaattagttactcctcctgtggctgatttcaagctaccaccttagagttcagaaaggatgtgcacagttggctc

SEQ ID NO: 2087 - DNA, 308 bp, Homo sapiens
agcgacctcaagatacaactggcaactgaggaaaaggcctcaattgaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactccgcactgaaaagaaaataagattgataacttaagcttaacattctgaggcataaagaaacattaactttggagtattcatcttgactactgaaatac

SEQ ID NO: 2088 - DNA, 382 bp, Homo sapiens
actgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacgtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaagccttgtgtagaagtacaccagcatcattgtagtagagtgtaaaccttttcccatgccc

SEQ ID NO: 2089 - DNA, 548 bp, Homo sapiens
attaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtcggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattat

SEQ ID NO: 2090 - DNA, 559 bp, Homo sapiens
atattcttttttttagtctgtatctaaatgatggtatattttaattccagatatttactttatactgcagtaatgctcgttatattttgcaaaatttatgttgttcttttatttggaaatataaggcttttttagctcttgaaatctatattatagtcatataattttattatgttttgtggtaagaagtgcagcaacatattgagaacataataaaattatcctgtatttttaatgattatttattaaattcctctcattagagcctgttattaatgattgtaatgtattttctgtataattttactgcaatttattaaattctaatgacttaaattgtctgcttttcatgagtgcacacagttgaatgctgtagatatctaaagaattatttttcggccggttgtggtggctcatgcctgtattcccagcaccttgggaggccaaggcgggtggatcacgaagtcaggagatcgagacaaccctgactaacatggtgaaaccccgtctctactaaatatacaaaaaattagccgggcatagtggcaggcgcctgtat

SEQ ID NO: 2091 - DNA, 206 bp, Homo sapiens
gacagaaggggctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatg

SEQ ID NO: 2092 - DNA, 495 bp, Homo sapiens
gctgctttccaactgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaagttctggctcgcagtctcaatattcctgggttgtatgtgcacgtgggaccttcctggtgcggtaaa

SEQ ID NO: 2093 - DNA, 522 bp, Homo sapiens
cagaaggggcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctca

SEQ ID NO: 2094 - DNA, 109 bp, Homo sapiens
ccacaggaaatggtccaagtcaggctgacacacatattcaaggcattttgagattaatacaatcacatcatgattccagccattgacagacactattcaccacagcatc

SEQ ID NO: 2095 - DNA, 517 bp, Homo sapiens
tgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatgg

SEQ ID NO: 2096 - DNA, 580 bp, Homo sapiens
tacggctgcgagaagacgacagaagggctgaaagtgggtaatttataaagaagagaaatttatttcttctagttatgactgaggagtcccaggtcatggggctgcatctgttgagagcctccttacttgtggggactctctgagaagtgccaaagttagagcaggagtgccaaaagttagagcaggaaccagatttcctggtcttagcatacaagaaaatggaggcgatgggaatagagtgtgcgtttctaaagtttaagaagtcaggaaggaaagaaatagagcatactaggtacagagggtgactgtgccaagcaaggttttcaagttggggtgggcaggagcagtaaaactcatggaaatggaggatgtgctgagaatacttgaggaaacaaggcctgaggagatggaaagagaatttaaaacatttatctattatgtgattattataatatgaacctctgtttcctatgtgatgttccctgagtgtagaatttgtttctttcttactgtgatatacccagcacttgagatggtactgacagattgtatatgcttagtaaaatttgttgaatgactg

SEQ ID NO: 2097 - DNA, 453 bp, Homo sapiens
acagaaggggatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaaaagaaatgctgctaaaaggaattaagcgttgtagtaaacgcgtgctcatcctctaagcttga

SEQ ID NO: 2098 - DNA, 592 bp, Homo sapiens
acagaagggagttcacatacagctaagtatgttgctggtagtaaatgtgggcctggggttggtggacttctgcctttgaaactaaacatccctgcttataattatgtaggaagacttttctgctgaaaagatttgttttaagacaaaagcctttgtctttaaaaaacaaaggcttttgttaacagccttaaacaaaaggctctttaaagggtaagttgcaggtcagtattgataccagaacaataattttctatctctttgagatattacaaactgattttaaccttcagattaaaggtattaagaatatttcctgactggcatggtggctcgcacctgtaatcctagcactttggaaggctgaggcgggtggatcacctgaggtcaggagtttgagaccagcctggccaacatggtgaaaccccgtctctactaaaaatacaaaaattagctaggcgtggtggtgcatgcctgtaatcccagctacttgggaggctgaggcaggagaattgcctgaactcatgaagcggaggttgcagtgagccgagattgcgccactgcagtctagtctgggtgacagagcaagactcca

SEQ ID NO: 2099 - DNA, 375 bp, Homo sapiens
gagctggtgagtctagaaggacggactagagagagctggcattggaatggacaatcgctagagggcgccggagcactagcggagtcaacctccgggacccataagcagggcttctaggataaggaatggagtttgacccaaccccaagatatgccctggggatattggttttctcaggtgcatctgactctccggcctggattgcctcgctgcggagaggggacaaaaggttttgccctgagcatctggtgatgtcttccagtgcctggttaggttgctccgcggctggacagtctgactactctcaaaactcctcgtgacaggcctttctggggtctgatcgccctttgtttccttacacttgggcctgttatc

SEQ ID NO: 2100 - DNA, 496 bp, Homo sapiens
acttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagactcctcttcacacaagatggtagcaacaaatcataggtgcaattgcaccaaattcacagaagatcaattgaaaatcctcatcaataccttcactcaaaaaccttacccaggttttgctaccaaacaaaaacttgctttagcaatcaatgcagaagagtccagaat

SEQ ID NO: 2101 - DNA, 431 bp, Homo sapiens
gacacaaaaagcacccagaggagagtatttctgtgtaaacaggtaaattaataggtggatatttaatacacaaattcacatttgtttcaagattggccttgtgtgtatggatactaaaaaggaaataacactaatgcttcattcatttttttattccaaataattttgctaagccccattacatagccaactcactgttagacactttgttttaaaggtgaaagagttaatacatttgcttccaaagaacttactagtaaagttacacacacacacacacacacactcacacacacacacatacacacacagagaatgagagagagaattacgtattctataagaaataaaggtaatatagaaaatctaaactaacaaattgtgccaagctctttctctgctatttcctgaagttcaacaccctgcgggtc

SEQ ID NO: 2102 - DNA, 72 bp, Homo sapiens
atgaaggtacatatgcacacaaaattttgcctcatttgtttgctgacatttatttttcatcattgcaaccat

SEQ ID NO: 2103 - DNA, 373 bp, Homo sapiens
ggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactc

SEQ ID NO: 2104 - DNA, 262 bp, Homo sapiens
gaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatg

SEQ ID NO: 2105 - DNA, 581 bp, Homo sapiens
  misc_feature 440: n = A,T,C or G
acagaagggataattactgctaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatattttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggntgggggagtgcccatcttgtacatgatattcttagaggtaataaggtaatgatgcatgaatttattttataaactcttggactatgtatttgacatgtaaaatatgtacagtattaacgtcaaccatctctttaaagttag

SEQ ID NO: 2106 - DNA, 459 bp, Homo sapiens
actttcttaaatgttgcttttacatctttggctcagaacacagtatttctaactttgtttttcttattacttaggaaactagagaaatttctccttggaaatgtcagggggaaaatacagtatttcggattaactttagaaaactcaggtttaaggcttattgaccggaagacctctttcttatccaagtgtagggcaattcattgcaccttgaggtaggggaggagcaaaatcaggctggcaggggtccacggcagggcaagctctaggagctggtgagtctagaaggacggactagagagagctggcattggaatggacaatcgctagagggcgccggagcactagcagagtcaacctccgggacccataagcagggcttctatgataaggaatggagtttgacccaaccccaagatatgccctggggatattggttttctcaggtgcatctgactc

SEQ ID NO: 2107 - DNA, 485 bp, Homo sapiens
acagaagggggcagcagtgtgttacctgccgacagcataatgtgaggcaaggtctagctgctccccccggcatacaagcttatagagcagcctcctttgaagatctccaggtggacttcacagagatgccaaagtgtggaggtgttcgagtgtggatcaaggactggaacgtagcctctttgtgcccatggtggaaaggaccccagactgtcgtcctgatcactcccactgctgtgaacgtagagaatcctagcctggatccaccacaaccgtgtaaaacctgcagcgcctgaatcctgggaggcaagaccaagtctggacaacccctgcagagtgaccctgaagaagatgacaagccctgctccagtcacacccagaagctgactggtccacgcacagccgaagcatgaggaagctcattgtgggcttcatttttcttaaattttggacttacagtaagggcttcaactgttcttactcaaact

SEQ ID NO: 2108 - DNA, 517 bp, Homo sapiens
gatagcactagatactcattgttgcatgaaccctattgtgaactgctcatctgagggatctaggttgtgtgcttcatatgagaaactaatgcgtgatgatctgtcactgtctcactttggccccagatgagaccatctagttgcagaaaaataagctcagagtttccacggattctacattatgatgtgtattctcattttatggaagacatgttgccagagtaaagcacaatatattcatcttgaaatgtaatactgagaagatatggaagttatggaagttgtggccttcagaattggcacttacggagagactagaacacgggtgggtgagttgtgaggggcaggaagcatgtcttaatggacttaagcaattttcgtcaacgattcacagtaaaatctttcaatgtacaaaatttagtaatctgataaacaataaacaaaatatttgaataggcatttttcataagacgtacaaagggcagacaggcatacgaaaaggtgctcaacatttttg

SEQ ID NO: 2109 - DNA, 233 bp, Homo sapiens
ggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaa

SEQ ID NO: 2110 - DNA, 429 bp, Homo sapiens
ataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaat

SEQ ID NO: 2111 - DNA, 284 bp, Homo sapiens
atggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggct

SEQ ID NO: 2112 - DNA, 237 bp, Homo sapiens
gaagacgacagaaggggagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtggg

SEQ ID NO: 2113 - DNA, 531 bp, Homo sapiens
acagaagggagaatgagtgatattgtctgggccagcagcccccaacgtttttgccaccagggaccagtttcatggaagacaatgtttccatggactggaggtgtggggatggtttcaggatgaaactgttccacctcagatcatcaggcattagattctcataaggagtgtgcagactcaatccctcgcatacacagttcacagtagggtttgtgctccaatgagaatctaatgctgctgctgatctgacagtaggcagagctcaggcagtaatgcctgcttgtccactgttcatctcctcccgtacagctaagttcctaacaggtaccagtgtctgaagcctggggactggcggctgctggtcaaggccacattagtttattgttaagtgcaaggtttctggtaacagaaataaagaattcaattgattcatcatcaagaccaaatatatttactaaagatctaccttaaattcattttttagcaggtagtatggcattgtggttaagaatttacatttgtgaacattta

SEQ ID NO: 2114 - DNA, 571 bp, Homo sapiens
gacagaaggggcgaggcccctgcagcagcagcggcgtggtcagagcgagcttcggagaagcagtggtgggttccatgtgatggtgtagtaggaggcaggtctccgcggttcatctgtgttgctctaaatgacactgtttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatct

SEQ ID NO: 2115 - DNA, 417 bp, Homo sapiens
gttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaatgagcccagttgctcaactgtttggttgaaaaccttgctcattttttaatgcgaaggctaagtgtcaccccctttctctacctctggctgggccttgctaagggccaaggaaagaaagacattttttagggggcagccagtccaaatgccaaaagaagaccagttcttgccctgattgtatggaatttgac

SEQ ID NO: 2116 - DNA, 328 bp, Homo sapiens
gttgggatccgtctcctctttcgcctcctgcaccttgggagccccgggctactctctcacagcccctgttgccctgtgatctgtaggtccttggggacgcatagtcaaggtgccaggacatcctggaagctgggaaatgatttcttccagaccatggctggagaaggaaagaaggtgtgttttgcctgactcagtgactatagagagaaccaagttctgcaggcctgtcacctaagtctcagctgggtgccacaaactctgaactggattccaaggctttcatgaatgcacttatgtttgctgtggcagctgcattatgtcgtggggg

SEQ ID NO: 2117 - DNA, 191 bp, Homo sapiens
atgttcagtttgattttaatgcatttcagaatctggacaacatcttacaaaatgtctgattattatcctattttttctgtagaattctagaaagggaattacaattgggggtgcagggtaaatctattttctgacagtggtatgcctttgctcttacaatcttatcagctgaattgagggaaaattcatat

SEQ ID NO: 2118 - DNA, 288 bp, Homo sapiens
gatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctgggga

SEQ ID NO: 2119 - DNA, 359 bp, Homo sapiens
agacgacacaagggtactgctgcgagaagacgacagaagggtacggctgcgagaagacgacagaagggtacggctgcgagaaaacgacagaagggtacggctgcgagaagacgacagaagggtacggctgcgagaagacgacagaagggtgcggctgcgagaagacgacagaagggtacggctgcgagaagacgacagaagggtacggctgcgagaagacgacagaagggtacggctgcgagaatacgacagaagggactttggagactccaaggattttaggaattctatggcagaaaatggagatgaacaccacatagaaggccgggcacactggctcacgcttgtaatcccaacac

SEQ ID NO: 2120 - DNA, 509 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacaggagggtacggctgcgagaagacgacagaagggtacggctgcgagaagacgacagaagggtacggctgcgagaagacgacagaaggggctttcgcgtctgcggtgcccggagtgtggtacttctcctagttgcagtcaggcttcatacgctattgtcctgcccgttagagcagccagcgggtacagaatggattttggaagagggagtcaccactggacctccatggtggccacgtgcagacatctacaaccttcgatctcctgacgaaaactggcgatggaatatgagaggagccctc

SEQ ID NO: 2121 - DNA, 383 bp, Homo sapiens
atgtattgaaaacttggccattttaccccattcctatgaatgaaaactatttggtgaatcagaggatagtctgaattgggatatgaaggccagtataagtgtcagttagcaaagtcagctctagtttagtttttttttttttttttttagggggtacctttcctaaaattttactttgggaacccttgaacctttttaaaaattttaaaggggttaacagttttgggcaatttgcctattccaaaaacctaaccttgggttcatgtttccaaggcctaaagaaaaatggggaaaataaaaaacctaaaaaggaaaggggattcctgggccttccccttttaaccttttaaaaaaaatggaacaaattggattttgggggaaaa

SEQ ID NO: 2122 - DNA, 432 bp, Homo sapiens
attaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaact

SEQ ID NO: 2123 - DNA, 485 bp, Homo sapiens
tacggctgcgagaagacgacagaagggtacggctgcgagaagacgacagaagggtacggctgcgagaagacgacagaagggtacggctgcgataagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgataagacgacagaagggtacggctgcgataagacgacagaagggtacggctgcgataagacgacagaaggggcttttttttctgggctcggacctaggtcgcggcgacatggccaaacgtaccaagaaagtcgggatcgtcggtaaatacgggacccgctatggggcctccctccggataatggtgaagaaaattgaaatcagccagcacgccaagtacacttgctctttct

SEQ ID NO: 2124 - DNA, 509 bp, Homo sapiens
acagaagggtggcaacccgctcaggcccccttcccattgtggaagctttgttctttcactctttgcaataaatcttgctgctgctcactctttaggttcacactgcttttatgagctgtaacactcaccgcgaaagtctgcagcttcactcctgagccagcgagaccacgaacccaccagaaggaagaaactccgaacacatctgaacatcagaaagaacaaactccagacgcgccaccttaagagctgtaacactcaccgcgagggtccgcggcttcattcttgaagtcagtgagaccaagaacccaccaattccggacacaccattgtctgagtaagtttgggtgccaggactatgaggtcgtgtgaagacttccagccccatacctgcagaacagtctgcagctcactctgctctgaactgccccaactttgcacagatattctccattcctcgaaatgaaactgtatccttcaaagctcacacatttcgcttattggctcagcgt

SEQ ID NO: 2125 - DNA, 490 bp, Homo sapiens
gccaaaagaaatatctaaccattcaatttataaataattatgtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttt

SEQ ID NO: 2126 - DNA, 518 bp, Homo sapiens
tacggctgcgagaagacgacagaagggtacggctgcgagaagacgacagaaggggagaaattttattctcaaacttagttggcctcttttttttctgtcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctc

SEQ ID NO: 2127 - DNA, 145 bp, Homo sapiens
gacgacagagggtcggctgcgagaagacgacagaagggtacggctgcgagaagacacagagggtcgggtgcgagagacacgagggtacggctgcgagaagacacagagggtacggctgcgagaagacacgagggtcggctgcgag

SEQ ID NO: 2128 - DNA, 561 bp, Homo sapiens
acagaagggacggagtgaattatctaatcaacatcatcctcagtgtctttgcccatactgaaattcatttcccacttttgtgcccattctcaagacctcaaaatgtcattccattaatatcacaggattaacttttttttttaacctggaagaattcaatgttacatgcagctatgggaatttaattacatattttgttttccagtgcaaagatgactaagtcctttatccctcccctttgtttgattttttttccagtataaagttaaaatgcttagccttgtactgaggctgtatacagccacagcctctccccatccctccagccttatctgtcatcaccatcaacccctcccatgcacctaaacaaaatctaacttgtaattccttgaacatgtcaggcatacattattccttctgcctgagaagctcttccttgtctcttaaatctagaatgatgtaaagttttgaataagttgactatcttacttcatgcaaagaagggacacatatgagattcatcatcacatgagacagcaaatactaaaagtgtaatttgat

SEQ ID NO: 2129 - DNA, 517 bp, Homo sapiens
ggatggggacctgggactgatctcaggctggggccgaacagagaagagagatcgtgctgttcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtgtggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgt

SEQ ID NO: 2130 - DNA, 489 bp, Homo sapiens
ctaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatattgcctctgaaagttgatgcagcatttttgcctttccaaaaagtatttatccttactgctttttgcagtacttgtattttcacagatggattatctggggtaattttcttcaaagggattttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttct

SEQ ID NO: 2131 - DNA, 361 bp, Homo sapiens
ggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttccctt

SEQ ID NO: 2132 - DNA, 363 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggcttttacctcgttgcactgctgagagcaagatgggtcaccagcagctgtactggagccacccgcg

SEQ ID NO: 2133 - DNA, 86 bp, Homo sapiens
ttcttttttatctactagaagatagatctgcttgagtcctaccacactcacatacttttgagatatggctgattatgaaaaggcat

SEQ ID NO: 2134 - DNA, 415 bp, Homo sapiens
gacagaaggggcgcgccgtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcgtgcgtggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctga

SEQ ID NO: 2135 - DNA, 403 bp, Homo sapiens
gacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttacctttttttttcttggtaatcccctaaaataacagtatgtgggatattgaatgttaaagggatatttttttctattatttttataa

SEQ ID NO: 2136 - DNA, 460 bp, Homo sapiens
gttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtct

SEQ ID NO: 2137 - DNA, 482 bp, Homo sapiens
acccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgccccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgc

SEQ ID NO: 2138 - DNA, 129 bp, Homo sapiens
tacggctgcgagaagacgacagaagggtacggctgcgagaagacgacagaagggtacggctgcgagaagacgacagaagggtacggctgcgagaagacgacagaaggggtgctcagggagacaaccatt

SEQ ID NO: 2139 - DNA, 483 bp, Homo sapiens
ggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggtccttaaggaataaattc

SEQ ID NO: 2140 - DNA, 148 bp, Homo sapiens
gaagatagtctgtgcccaccgcatcgctaagtcctagccctctctgcatactccagcacacagaaactgctgcttcacttgtttgttgacttgaaccgaaccttgggtggcattaatgtgcctggcccaagactgaaaaattaagaac

SEQ ID NO: 2141 - DNA, 248 bp, Homo sapiens
gtgttgaggaaccactgaagtattgatttttaagccaaaaatgacatgacagggttttctttatggaaagatcactccaaattgcatgtagataagcctatgaaaagcaaagagataattgtctaggcaggaagtagtgaggacttcttgctttcctcaagatacactgaaggcagttgaaaagctcatttttaaaagtctggtgaaaaccactttgttcacttttgttttgtgggagatgtgacacc

SEQ ID NO: 2142 - DNA, 372 bp, Homo sapiens
aattctttttcctgagattccagcaaggttgtgacattgtcacttttttgttctagactcttttaaattttctgcatttgcctgaaaagcacccctgtaagaatagatttctcatggctctaaaaattattcccaagaataccttacttggttcaaaagcagactgtttctcttcatttcatctcaaatcagacttctgggcaagatgttctttagagtaagcaaacctacaacctaaaaatctcttcaagaggcatctctggtcttgtgacaagacctcttcaaaaacccacagtaaaactcccctccctccagttggccaccagtctgccaccaaacatgaacaaattctgctgctaatcggtttccctt

SEQ ID NO: 2143 - DNA, 148 bp, Homo sapiens
acagaaggggtattttgagtagagatggcttttcaccatcttggccatggtggtcttgaactgctgaccttgtgatccacctgccttggcctccctaaggactaggattacaggtgtgaaccaccatgcctggccttttttttttttt

SEQ ID NO: 2144 - DNA, 414 bp, Homo sapiens
acgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaa

SEQ ID NO: 2145 - DNA, 486 bp, Homo sapiens
agggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatataccatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcat

SEQ ID NO: 2146 - DNA, 303 bp, Homo sapiens
atcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttggtaatcacccataattttgtgtttaaacattgaaattatagtac

SEQ ID NO: 2147 - DNA, 505 bp, Homo sapiens
ggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagt

SEQ ID NO: 2148 - DNA, 526 bp, Homo sapiens
gtccgagaccttcaaggtaacccaattgcgaatgccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttg

SEQ ID NO: 2149 - DNA, 491 bp, Homo sapiens
atggcactcctacaaagtctccccctgctgctttggaagttgtgccatgtatcccaagccctgcagcaccttcagataaagccccttcagaaggagagggttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctcagtcatcagactatacaggacatgttcatcctggaacttacacaaataccttagaacgtctagtgaaggaaatggaagacacacaaagcaggctctaagcagaataaattccctgaaaaaagaaaaaggaactctgtggactcagatctgaaaagcacaagagaatctatgataccaaaagc

SEQ ID NO: 2150 - DNA, 173 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcga

SEQ ID NO: 2151 - DNA, 486 bp, Homo sapiens
gtataaatatcatgcacaatgttcaactgtaattcaaaaattaccagtgatggatacagaaaaatgtgacatgtaattttttttaaaagtccatggaaatagattcctcgatgattcagaagttgtagacaaggactttaaagcagaaattataaatatattcaggattttaaaaaaatatgttttcaggcccggtgcggtagctcacgcctataatccaccagatgtggtggcgtatgcttataatcccagctactcagaaggctgaggcatgagaatagatagcttgaacccaggaggtggaggttgcagtgagccgagattgctccactgcactctagcctgggcaacagagtgagaccctgtctctaaaaatatatgtatatatatagtcataatgagggaacagatgagaaaataagcagagaaatgaaaattttcaaaaataagtaaaaagttaaggtataatacctgaaatttttttga

SEQ ID NO: 2152 - DNA, 572 bp, Homo sapiens
gtccctgtactggagccacgaggccctgttccagaagaaaactctgcagggccctgagaattccacactgtgcccttccagttgctggcccggtacaaaggcctgaacctcaccgaggatacctacaagccccggatttacacctcacccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctc

SEQ ID NO: 2153 - DNA, 356 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggaatgaaaagaggaagaagtttgagaaaaagactgaataaatatctcacgtaaaccttcctgaaagataaacgttttcctgaattcagaaactagtagctaacattgcttctggagagcagaaataagcatgtcttctggc

SEQ ID NO: 2154 - DNA, 418 bp, Homo sapiens
gattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttccccctttttttccttttaaactcttgagcctcctataacgaaggattatgtgtttcaaacctttttttttttactgtttcattaagggtgcttgtgcccaaaatatttacttgtataatatctggaacttgcttaaatacttcagcaaagtcagcatatttac

SEQ ID NO: 2155 - DNA, 130 bp, Homo sapiens
aagactacagaagggacggctgcgagaagacgacagaagggacggctgcgagaagacgacagaagggacggctgcgagaagacgacagaagggacgggtgcgagaagacgacagaagggactgctgcgag

SEQ ID NO: 2156 - DNA, 276 bp, Homo sapiens
gatatttaaaggtttgccttttgcttctcgtgggtacaagccagagagagcagtggttacatgggggtagaatggtgactcgtttttacctgactgtggatcagctgggtggttcctgaatctcactgggctcattgtggctctttgcttgtcctgtatttactgtctgtggtagtgagatagaagaaccaccatgttcttctggttctagactcaaactacagggagaaggaagagatgtgtctggcatcatttccgtgttggagtaactttgtg

SEQ ID NO: 2157 - DNA, 466 bp, Homo sapiens
gaaaaaaggttggagtagctagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaact

SEQ ID NO: 2158 - DNA, 215 bp, Homo sapiens
atattagaatcaaagcaccaagacttcaaaagtccagactactcttcccaaagagaaatgtgcaatcacaatagcatgacatgggtacaaatatggaagtatgttattaaagtattgagaattagctttcctaacctccccacctgcaatcttttactcctaatctccaaaaaatgaacaaatcattggctcaaaatggtcacaaattgtatgtg

SEQ ID NO: 2159 - DNA, 274 bp, Homo sapiens
gtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcact

SEQ ID NO: 2160 - DNA, 462 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacgcctgcgagaagacgacagaagggtacggctgcgagaagacgacagaagggtacggctgcgagaagacgacagaagggtacggctgcgagaagacgacagaagggtacggctgcgagaagacgacagaagggaacgcctgtaatccctgcactttgggaggccaaggcgggtggatcacgaggtcaggagatggagaccatcctggccaacacggtaaacctcgtgtctactaaaaatacaaaaattagctgggcgtggtggcgcatgcc

SEQ ID NO: 2161 - DNA, 485 bp, Homo sapiens
gtgaattctgataatgaaaaaagttttcctccaggtatgtttgtttcacattcagtcctaaagccttgagctatgtgtacttccctcacacaggaacaccagctgtcctgtctgtgctctgcctgcgcccaaaactcaatattttctctcagcacagaagtcaaaaatgagatatgccccttataaaaccccttcgattcctgagaaaacataataaagccatatgttgcttccttgttggggctcctctacaatgctcccaacacctgtgacccctaggaagacagggagcaaggtggatctggccaggagtcacaggatatacacccattctggagctttcctctgttgttctagaagatgttatttgattagttggggctgggagcaggggatatatgattttgtggaaaaggtatcagataatcaaatcaggtctgcctctgctatagccagtgtgctgctgcattaaaagggaacaaaag

SEQ ID NO: 2162 - DNA, 526 bp, Homo sapiens
atgctacagctgtaaccccatgcctgagagttgcatgagtactgatgactgcaaattatttatttttgtatcctcaattccttgaatagttgaattggggctcaatacatgtttactaaatgatgattgcatttaactgtgagcagctttttcagatattaatcaaaatgcctgcaaagactacacagttgcaagggacatcagcttatatcccaacattattggttcctgatccatagttgtgagaccttggttgattccctgatagtacagcaactccctgggaatggaagttcaacttgttggctttagaacaacataagcagtttcattgaacattcactgaatgtctcctctgtgctgagcccatgtcagggactgggtctttaatcatgttcttgtatgcagcatccctgcactctacctgcacatgacttctgaacagcatgctctgcccagacagcctcagtgagggccaggacttgaaccctgtggaagcatgtaaagacatatttccgtggtggca

SEQ ID NO: 2163 - DNA, 557 bp, Homo sapiens
gcagatatttaagtgataattacaatataatgtgataactacattcctagtaatactatgatattttgtgagcacggataatgtgttgctttaaaaagataatcagcttcataaactagattctaaattaacaagcacagtgctaacactcccctgactgaacagttatacaaaaggctaagggtcttagaatttattgtctttcttgctgaaagatgattctaataacaataaggttttccccctcctataattttgtgtttccaaaaacaaatggtgaggaaacaatagagtatgtttaccctttctggactcagggacagggtctctaatttggtctctgatttggacagctgctatttgccttagaccttttaggttgtgtttctaaagactgaggctaaattgaacatgacagagaggattcaggtgaacagattagctcatctgtcttccatcagcacacctgttgcccccaacagagggcagaaccatttctctttcaagcatgggctactgataaattcagctaggcgagctagttcagccttctcatt

SEQ ID NO: 2164 - DNA, 136 bp, Homo sapiens
aaagtgggcttaatggagtttttgtggcctcagctcaatgcagttagctgaagaattgaaaagtttttgtttggagacgtttataaacagaaatggaaagcagagttttcattaaatccttttacctttttttttt

SEQ ID NO: 2165 - DNA, 125 bp, Homo sapiens
aggagaattctgcctaagccaactcgaaaaagccgtacaaaaaataagcaaaagcgtcccaggagccgtactctgacagctgtgcacgatgccatccttgaggacttggtcttcccaagcgaaat

SEQ ID NO: 2166 - DNA, 157 bp, Homo sapiens
tacggttgcaaaaaaacaacaaaagggtccggttgcaaaaaaacaacaaaagggtccggttgcaaaaaaacaacaaaagggtccggttgcaaaaaaacaacaaaagggtccggttgcaaaaaaacaacaaaagggtccggctgcaaaaacaccacaa

SEQ ID NO: 2167 - DNA, 244 bp, Homo sapiens
ctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagct

SEQ ID NO: 2168 - DNA, 549 bp, Homo sapiens
acagaagggattgattcttgactgcaaaataccttgaaacccttatataaagactgaagtcaacggagcctagtgaaagacttactttgtggcttgtggttaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagctgtattttttttcataagtggcatataaatctcattcaatgaaatggggaaatcacgttgagaagttggtctgtcatcttccattgag

SEQ ID NO: 2169 - DNA, 564 bp, Homo sapiens
gattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacactgatcacttccccaatcaatacccttgtgatttcttatgcctgtctttac

SEQ ID NO: 2170 - DNA, 436 bp, Homo sapiens
tacggctgcgagaagacgacggaagggtacggctgcgagaagacgacagaagggtacggctgcgagaagacgacagaagggtacggctgcgagaagacgacagagggggaatatgtgcttgcctccttttcaccttctgccatgattgtaagtttcctgaggcctccctataagcataagtctgtacagcccacagaactgtgagccaattcaatcccttttctttttcaattacccactctcatgtatatctttataacagcgtgagaacagattaatacactcctcctcagaaagcattcaatttagttgtgtctaaagtatgccaggtgttctagggtgttatcttagccaataattcttcctcttcagcaagatctatttgcctatgacagcttgacctacatttcctaccatacttgtcagtaacaagtag

SEQ ID NO: 2171 - DNA, 409 bp, Homo sapiens
gttcacactgcttttatgagctgtaacactcaccgcgaaagtctgcagcttcactcctgagccagcgagaccacgaacccaccagaaggaagaaactccgaacacatctgaacatcagaaagaacaaactccagacgcgccaccttaagagctgtaacactcaccgcgagggtccgcggcttctttcttgaagtcagtgagaccaagaacccaccaattccggacacaccattgtctgagtaagtttgggtgccaggactatgaggtcgtgtgaagacttccagtcccatacctgcagaacagtctgcagctcactctgctctgaactgccccaactttgcacagatattctccattcctcgaaatgaaactgtatccttcaaagctcacacatttcgcttattggctc

SEQ ID NO: 2172 - DNA, 182 bp, Homo sapiens
ggccgcccacttttttcataaaagagcagacatcttgttatcctgctttgttccagatttttgctgagaagtagttactgtgcacatgtgtagatttgcagttctgtggctcctgatggatctgagaagatggacgtggaggatgaaaatctgtctgattattttgaactgatgtttgttgc

SEQ ID NO: 2173 - DNA, 440 bp, Homo sapiens
agcccttttccctgtgtgccctttctctggcattactgagctgctggtagtgccctactcactcatccttctgttgtaggcaaatactttcattctttcaggcctcgctcccgctcttgctgctaccgggcatgctgtcaccctttcctgccctctaccccttttaatctggccagcctcaatatttaagtctctgcttgggcatgtgttctagaaaagccatccctgagatgctttattttcattctttttagaccctaatgcctagcatgtatgtagcaggactcaatacaaattttctgagtaaaacaaagactgtttttacaaagatgatgtgcaagactctcccctgcagttttggagcagaggggacagacatatggagaaataatgtacagcttaaggggtaaagatgccgtagaaaaatcagtaaaatacta

SEQ ID NO: 2174 - DNA, 143 bp, Homo sapiens
gaagtcaccctgcagccaggcgaatacaccacaaaagtctttgtcgccttccaagctttcctccggggtatggtcatgtacaccagcaaggaccgctatttctattttgggaagcttgatggccagatctcctctgcctaccc

SEQ ID NO: 2175 - DNA, 103 bp, Homo sapiens
gagtcatttgatcttatgattaaagaaaatccatcctctcagtattggaaggaagtggcagaaaaacggagaaaggcgctgtatgaagcacttaaggaaaatg

SEQ ID NO: 2176 - DNA, 139 bp, Homo sapiens
gaatttttaactttctttcactacattggcacttaaattttttctttataaagctttttgaaggtcataaacaaagaccataattgatgatagacctaatacatttcctctgtgtgtgtgtgtaacattccaaatactt

SEQ ID NO: 2177 - DNA, 155 bp, Homo sapiens
gccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggc

SEQ ID NO: 2178 - DNA, 73 bp, Homo sapiens
aaaggagtgctacaaagttaaatactgatttttaaaaaaattggcattcacacaatttctactaccacagatg

SEQ ID NO: 2179 - DNA, 238 bp, Homo sapiens
gcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactt

SEQ ID NO: 2180 - DNA, 422 bp, Homo sapiens
gtgagctgtggccttttgcgaggtgctgcagccatagctacgtgcgttcgctacgaggattgagcgtctccacccagtaagtgggcaagaggcggcaggaagtgggtacgcaggggcgcaaggcgcacagcctctaaacgactcgctttccctccggccaacctctgaagccgcgtcctactttgacagctgcagggccgcggcctggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagaaaaaatgagctgtccgcaggcttgtccaaaaggaaacatcggaatgaccacttaacatctacaacttcc

SEQ ID NO: 2181 - DNA, 284 bp, Homo sapiens
gtttaagtcctgtctgtctgtaaggcgtaaaatctgtccgtctgtaaggcgtaaaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggac

SEQ ID NO: 2182 - DNA, 267 bp, Homo sapiens
gaaatatgttctccacgggtagtgggaacacttatgcctacggggtcatggacagtggctatcggcctaatcttaaccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgg

SEQ ID NO: 2183 - DNA, 136 bp, Homo sapiens
gtccccaacgaattaaatattatgtcctaccaacttattagctgcttgaaaatataatacacataaataaaaaatatatttttcatttctatttcattgttaatcacaactacttactaaggagatgtatgcacct

SEQ ID NO: 2184 - DNA, 338 bp, Homo sapiens
gactatttttcttttggatgattgattttccttttgctataagtttttagaagcttttttctatgtattttaacatttctgtctgtgatattttgtgtgtgaaaaaaaacacactcaatgtgttttttcctatttttctcacttgaaaacaccaatcaacacagacagaagacttctgtgaccaaatatgggggatctctctgcaagaaaaggcagcccgttctgcagtagacaccagctgggtggcctccaattcagttttgacaccatctatttggagatagcatcagatcctacaggttgagggctcaggccccaaaactggccacccccaaccc

SEQ ID NO: 2185 - DNA, 368 bp, Homo sapiens
ggtgggcaaaagcgggatggggtggctggaccatgcggaactggatggtccggatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcag

SEQ ID NO: 2186 - DNA, 375 bp, Homo sapiens
cagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcac

SEQ ID NO: 2187 - DNA, 297 bp, Homo sapiens
gcttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttacttttttttttttttttaacagggtctaattttgccccccaggcaggagggcaggggctaaattttgggctcattgaaccctaaacctccaaggttaaagcaattttcctgcctaaccc

SEQ ID NO: 2188 - DNA, 561 bp, Homo sapiens
ctggccacacaggaagagctgttcttcctgtgtctgaatccctgtctccctgctcattcattcatcgctcgcctctatcctcagtctcttcatttattacaggctctttcttatccgtatttaaacaccgtcatgtcttggccatcctgcaggaaataagcagagttcctctgtgtccagcactttatcctaaatttgttactccatgattacttcgtagaacctgccgatgttttccaagtagacagttttgttcagttaatctttatttattcattcccacagtatttactgttttctgatgcagagatgaacaattgacagcttctgttctcaaggagcttatgggggagggaaaatgccccccaaacatccctttaataattaaaaaacaacaaaactttgattgtacgctttttctttgaagaaagaggcttactgtaagttggtgttttacctactaattgaaatatatgtctgttttttgagacagagttttcactcactctgtcgcccaggctggaatgcagtggcactatctctgctcactgcaactgctgc

SEQ ID NO: 2189 - DNA, 332 bp, Homo sapiens
gtatgaaagaacctttttaaaatggctggttgttccagatccagatttctctgcacactggacttcgtagagtaagtgtggtagacaaagagactacactgcacaaccaccagtgaatatcattgctaagaagactttgggtcgtgtttctcagccactctcacagcttttgtagacttatttgattttgaaacaagcagttagctaaatctattttccttttatgcatatatgttaattggctcaacttaatatggtgttcttacagaatatgagcccatttgaaataaggttttaggcaattttgctgttggctctgatttgtatatagc

SEQ ID NO: 2190 - DNA, 541 bp, Homo sapiens
acagaagggggcaggcagcgcagggcagacggccgcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctg

SEQ ID NO: 2191 - DNA, 195 bp, Homo sapiens
gctgttgcccaggccctagaggtcattcctcgtaccctgatccagaactgtggggccagcaccatccgtctacttacctcccttcgggccaagcacacccaggagaactgtgaacctggggtgtaatggtgagacgggtactttggtggacatgaaggaactgggcatatgggagccattggctgtgaagctgca

SEQ ID NO: 2192 - DNA, 114 bp, Homo sapiens
tggtgttggaaagataatcttctgtctcgattactcgaaatgagtttaatctggaaagcaggagcaccgttggagtcgagtttgcaacaagaagcgtccaggttgatggaaaaa

SEQ ID NO: 2193 - DNA, 447 bp, Homo sapiens
aaggacataaaagaattttataaaaacattttatatattttaagattgaaaagtttaggcaaatgtaagggcagagcatcaccaaacattatagtgggaaaggatgtaagaaacaaagtctagtgacttcatttttaaataagcaaattgaggcacagggtagggcacaaaggttacacaaaccatattgaccaccatcgcagatcatccttagagacctagacgtgatagtctatctgaatttacaatctgaggcttcaatctttccactacaatcagggtctaagcaatgtttcctgaggagcaaattgccttgggctcattttttgagacttgttgaattgtagtccccttcatcagaatctcaaattcatatataaaggagtatcctgaaaacattggttgttatcaaaagaggtttttttgtgtgtttttttttgttttttt

SEQ ID NO: 2194 - DNA, 474 bp, Homo sapiens
gaagcaatgcatcgtggcctcctgtgaatccgccatactacatcccgctggttgagctggtcccccacccggagacggcccctacgacagtggacagaacccacgccctgatgaagaagattggacagcgccccatgcgagtccagaaggaggtggccggcttcgttctgaaccgcctgcaatatgcaatcatcagcgaggcctggcggctagttgaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctg

SEQ ID NO: 2195 - DNA, 527 bp, Homo sapiens
atagttcgaggtcttggctttacatctttaaacaactttgattttacttttgtatttggtgatagatactagtctgttttcattcttctgcatatggatatccagttttttcaataccatttcccaccagtgtatgttcttggcacctttgtcaaaaatgagttcactgtaggtacatttgtacatttgttacttttctctattctgttccattgatctatgagtctatttttatgccagtaccatactcttttggttgctataattctgtggtataatatgaagtcagaaaatataattcctccagttttatttatttatttatttttgcttaggatagtattatttcttatagtgaaagcattctatgttatttattattagtctaattttgtagttttacaatgctatcctcttttacaaagctatgatcaactcagtgtgtccagatcaggatcatttgtagctatttgcaaaagtagcaatattctggctgggcatggtggctcatgcttatattcccagca

SEQ ID NO: 2196 - DNA, 104 bp, Homo sapiens
gacagagggggcgaccgtatccgctagcgcggcctgtgatgcgcttgggctccctgtgcgttcccacttgcagggcaccacaaggagaatgggcgtcatgactg

SEQ ID NO: 2197 - DNA, 414 bp, Homo sapiens
ggctcaatatgacacctagatatgtaacctcttcatggaaaatttgggctttcttttttgatattttgtaacttgctttctataggagatggaggagatcctgggttccccgataacactcctctcaggttggggcaggcaaagaaagctcgtctatgtactgcaacaaggcacagttgttacttggctgggtataggccatgaggtctggggccaatgtttctctaaagattgtgggagagaacggggcatggtggtttgcgcctctcatcccaacactttgggcggccacatggctggatcatgaggtcaggagtccaagaccagactggccaagatggtgaaaccctgtctttaccaaaaatacaaaaattaggcagccatggtggcaggcgcctgtaatccagctaccca

SEQ ID NO: 2198 - DNA, 407 bp, Homo sapiens
ggagccttgcagagagtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatct

SEQ ID NO: 2199 - DNA, 487 bp, Homo sapiens
agaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgt

SEQ ID NO: 2200 - DNA, 572 bp, Homo sapiens
ggggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttccca

SEQ ID NO: 2201 - DNA, 404 bp, Homo sapiens
tgggaatatgcacaaacttggcttctttaaccaagatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagt

SEQ ID NO: 2202 - DNA, 500 bp, Homo sapiens
gaagcatctccatcctggacttactgggtgaggctgccctggcagaaagcacagtgcctgcagacatgctgtcactgctccacacatcaacgctggcagtccttggggctctgtgtgtatatggtgcaggtcacctaaagcaacctcaaatttccagtactaaaacgctgtcaaaaacagcccgcctggaatgtgtggtatctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtgggaagtgcacagcagcagacagtttgagccatcccattcaataaatgtttattgagtctttgtttataattacgaa

SEQ ID NO: 2203 - DNA, 561 bp, Homo sapiens
ggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcgtcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgc

SEQ ID NO: 2204 - DNA, 387 bp, Homo sapiens
atttaccacgtggctgagaaagagacactactggcctgggtgacctccaaattcgagctctatacctgcctcagccctctggtgaccaaggcaggtgcagtcttggtagtgaccaaactcctgcgctgggtgaagaaagaagaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatg

SEQ ID NO: 2205 - DNA, 384 bp, Homo sapiens
tgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggacacagctgggcaggagcggtaccggaccatcacaacagcctattaccgtggggccatgggcttcattctgatgtatgacatcaccaatgaagagtccttcaatgctgtccaagactgggctactcagatcaagacctactcctgggacaatgcacaagttattctggtggggaacaagtgtgacatggagga

SEQ ID NO: 2206 - DNA, 152 bp, Homo sapiens
ggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatg

SEQ ID NO: 2207 - DNA, 561 bp, Homo sapiens
gatcaccacagccataaaattgtttaagaaagatttatataatgtttacaaatctggaatcaaggattttggctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatga

SEQ ID NO: 2208 - DNA, 442 bp, Homo sapiens
ggccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccacttt

SEQ ID NO: 2209 - DNA, 438 bp, Homo sapiens
atagcaaatgcttacctaaaaatagcaacaacctgcgaaaaacatcatgtgttttgccgtttttatttgaatgactatttactttgcagtctactagcaagctatagaattgtgtgatacgcagaattttaactgaagtgctttaagtgaacatttaaacatgataaaccatattaatggtgtttatgttaatatacttgaagtgaacattttctcttcatcatgagtaatataacgtacccctcaatgaaagtctagaattagagtaaatttgctaattaattaataacttttccataatatttttagttatgtgcttaaggctcttttagtgtttctcctactttttaatagcttatgccttttttgcctttgttttttattggttcattttaaagcaaaaacctcataacgtgttatttggaagcactgtaacct

SEQ ID NO: 2210 - DNA, 451 bp, Homo sapiens
acaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactc

SEQ ID NO: 2211 - DNA, 541 bp, Homo sapiens
aggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtg

SEQ ID NO: 2212 - DNA, 484 bp, Homo sapiens
cgaaaacggcccaggcatccacccagccgagagcacgatggctactggggagctcggggacttgggtggctactacttcaggttcttgcctcaaaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagtaagtacagaa

SEQ ID NO: 2213 - DNA, 442 bp, Homo sapiens
aaaaagaacaaactttcttaaatgttgcttttacatctttggctcagaacacagtatttctaactttgtttttcttattacttaggaaactagagaaatttctccttggaaatgtcagggggaaaatacagtatttcggattaactttagaaaactcaggtttaaggcttattgaccagaagacctctttcttatccaagtgtagggcaattcattgcaccttgaggtaggggaggagcaaaatcaggctggcaggggtccacggcagggcaagctctaggagctggtgagtctagaaggacggactagagagagctggcattggaatggacaatcgctagagggcgccggagcactagcagagtcaacctccgggacccataagcagggcttctaggataaggaatggagtttgacccaaccccaagatatgccctgggga

SEQ ID NO: 2214 - DNA, 413 bp, Homo sapiens
aagacgacagaagggtacggctgcgagaagacgacagaagggtacgggggggagaagacgacagaagggtacggctgcgagaagacgacagaagggtacggctgcgagaagacgacagaagggggttctgttgtctacacggaggccagatttctttatccagggagccagaaaaacaagtgcattttcttccttcagtaaacaggtcactggctcatcactacttgaattagcccctttgttttctccttattagggggaaggaacactttatttcttcctcatttcttccagttgtctggtgcctggccacttcataattgtattttgagagaatagatattaattttcttcaacaaaaggcggagctccttgatgacacaacataattcaatttccgttctctcccctca

SEQ ID NO: 2215 - DNA, 428 bp, Homo sapiens
atttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacacctt

SEQ ID NO: 2216 - DNA, 539 bp, Homo sapiens
atgccaggtgagtcctaagaattcaagtcctgttctcattaaaacctgctggctagactcatatggactgactggtgggaatagtttgcgagtagatttagaaatgggacttttaggcttccttccccacttgcttaaaccaaaaagcttgaaaattaataggtgtctctttgttatatatttttttcactgtgcactcacaatctttctgaacgaggatgctctgagatgtatattggtccaattaaatgcatctgattaaaactgtcaaaccaaaaaggaagtgagttgaaaagacattctctaccgagaatgcagcaagagttgtagatatcaagttactgagttgctgcttgagaactgaattataaataaatgtgttaggtagtggaattttgttttgttttccccaaaggagaaatattcgccacatggaaacaaaatttattcagcatattttcattctgtaattgcaccattgctattcttaattctttgtgtttctgatttaaagggaaaacacacacaaaaacagactg

SEQ ID NO: 2217 - DNA, 573 bp, Homo sapiens
acctaaatatgagcccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaccacttttcatgtctaaaacatttgtttgtggtctataagatgaaacatcatttcaatcgtaaaatttcccattaa

SEQ ID NO: 2218 - DNA, 602 bp, Homo sapiens
agaagattacatttgggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgatcctcccacctcagactcccaagtagctgggactacagtcatgcaccaccatgcccagcta

SEQ ID NO: 2219 - DNA, 367 bp, Homo sapiens
acagctgataattggttaggctcaggatttgaaaccagccaaactgagtagtaattatgtgtttacctgttatgctcttatttccgaggaatagatgacagttctcactagagatagccaaatttgtgtgtttgtgtatgtgtgtgtatgtgtgtgtatgtgtgtgtgtgtctgtttcttttttttttcccctttgtttttgaaacagggtcttgctctgtggcatgggctggagtgcagtggcactgtcacagctcactacatccttgaccttctgggttcaagtgatcctcctacctctacctaagcctcccaagcagctgggactgcaggtgcatgccaccatgcctggctaattctttaattt

SEQ ID NO: 2220 - DNA, 235 bp, Homo sapiens
aagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctct

SEQ ID NO: 2221 - DNA, 554 bp, Homo sapiens
atagtacataattgataaattaatttcagatacatattcttgctttgaaccaaattagtaaagtgactaatttatctgcatttcagagaaattgtgcagtttaaagttgaatctagagagggagggctggtttctttggggttaaatttctgtagattcccaaacactgacatcaaatctttagtggaacctggaaaaaggaaggagaaagtattttagctcagttaatgttcttccttcgttagatgtgatgaaaaatacacagtctaaccattgtgtagaagaaatacttgtttcttaacagcagcaacaaaatgtcatttattaagcacttacagacatcttaccaggctttattctttatttcatttagttgttacaaccagcttatgaagtagtttatcagtcagtattagacatctaacaataacagaccagcaaccctcaaatcccagtgagatatatatatgtgtatatatgtatatttgatgatatatatgtatatttgatgatatatatatatgtatatttgatgatatatatatatatatatg

SEQ ID NO: 2222 - DNA, 398 bp, Homo sapiens
gaaatccagtaatttcttgagcagaagaaagggaagtggaattactgtagaaattatgcatagttttatattatctgtgtagtagcctgtttaaagtgatcattgctagtgcatggtatagaattacaaacttgtaaatacttctcaagattgccactttaaaaaaaaaagcaaaaagagctctgtagccctatttttttttttttttccaacaggaaatttgtttttgtttcaaaatggggaaacaccctttattttttgtgggccacataaatgtcatccttttgtttattgcaccaaaaaaaaagtgaaaaatggttgatacaggggcaagctgttctttttaggttactttaaaaagtcttggattttcggatttccaaaaaaagcttagggaa

SEQ ID NO: 2223 - DNA, 551 bp, Homo sapiens
gtttgaaagattttctaaccgtgccttttagttagtcttaaatttctaattgtagttaaaaacatgccattgtcatttctgacattttaagtatatggtttagaagtggttagtatagttctattgttttgcagtaggttttagataatttgtgtcttacaaaagtaaaagtgaatactcattacttatgaaagaagttagttagcttgccttaggtagatagcaagagaagagtccctggaaagtccctggtcagtgcctcatccctgcataacatataaagaagcctggaaaaaatcaagctgcagacactaacaagggaactagcatatgttgttgtgcttggggacatgcccgtggctgcacagatagaaaaacctctggcccatttggataaaaacttgtagaaacctccagctcactcagataaaggaacaagaacgacctagcatagaaatgcctttgtttggccgggcacggtggatcatgcctgtaattccaacaatgtcggaggcagctgtgggcggatcatttgaggtcgggagtttgag

SEQ ID NO: 2224 - DNA, 365 bp, Homo sapiens
gtctgcttcattcattttggctctatgtggtggcagaagggcttctggcatctccggacctttatgcctcccaggtccaaacccagccagaaaggagagtgagagtgctgagtgcaaaactctcctatagctcctatacaagtccaggatttgctattagactccttgaattatgtgcccagctctgagccaatggctgtgcttaggaggctcctgtctcatgcacccaccccagtactgggcatcagaaacaaccagtgatccctataatgaaccacgggttcacagacttaagtgtaatcctgcagcagggcctcaggaagacttgaaacccaaaatcagaaagccatggtttcttgtcttcc

SEQ ID NO: 2225 - DNA, 500 bp, Homo sapiens
cagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccagaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacaatcaagttcagtgtatttgttaatatcaatttgggccccaaatctctctcacagtcttcct

SEQ ID NO: 2226 - DNA, 392 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggactgttggcccgggccgagaagaaggctgctggcaaaggggacgtcccaacaaagagaccacctgtccttcgagcaggagttaacaccgtcaccaccttggtggagaacaagaaagctcagctggtggtgattgcacacgacgtggatcccatcgagctggttgtcttcttgcttg

SEQ ID NO: 2227 - DNA, 479 bp, Homo sapiens
tacggctgcgagaagacgacagaagggtacggctgcgagaagacgacagaagggtacggctgcgagaagacgacagattggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggctttctggtctcggccgcagaagcgagatgacgaagggaacgtcatcgtttggaaagcgtcgcaataagacgcacacgttgtgccgccgctgtggctctaaggcctaccaccttcagaagtcgacct

SEQ ID NO: 2228 - DNA, 593 bp, Homo sapiens
gttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgttgttcttatgaagaagtc

SEQ ID NO: 2229 - DNA, 619 bp, Homo sapiens
agccaagatcgcgccactgcactccagcctgggcaacagagcaagactctgtctaaaaaaaaataaataaataaaataaaataaaataaaactgccttgattaagtaccttcaaatcagtgattaactagcaactctagccctgaattctgaatcttttatttttccttcaaaaggtaactcttaaaccatcccttctacttaatctgcatattgtactgaggttatttatcttccaacgtttgccagttcccttaggaatacccttagcaaccgcctttccatacaaattgcctgggaaagtttaaggggatcaaatcccttgtaactaaacaaaatagggcttttgaatagaaatttaatagcaaattagattggcatcattacaggaggatgaatgaaacttttgttttctttacatttacagtagaaaagtcaactaactctccaatatacaatgagctggaagagagagattttttttggcttattttatgatgtgtcttgctttcaccacattctgtcaacttccacaacaaatttaacctccaaaacaaatcttaaacctggtctctctcactcactgctgctccatttttcctaatggagttttctcttgg

SEQ ID NO: 2230 - DNA, 552 bp, Homo sapiens
aatttccactcagctcaaaacacatttgaatcttttattaaggttgctttgaacctaatgaggcttaaaatattgctgcagcatatttagcaaagtttttctgactcataacagttttatgatttttctcttatcctcagttgctatacctgcctttcaggaactgccctcgttttcaagaacttgagagtgagactttgaaatcagaggaattccagaagaggctgcacccttataaggttaaaagctagttttgtttagtggtacttgttagtttgttagtggtacttgagtgtgagggccaagacacaagatgaagctttggcttcttaaaaagatgggacgaatgcatctgtcagtggctggttacagcaatgggttagaatatttaatgagggaggtcatcactcctgcttcccttccccatacaggggtcacaagccaatagacaagccagtccttttgaatcctttactcatggccttgagaggaaccaggtgtgagtaaatggctggatgagaataaatataagtctaaaatcacctgccttat

SEQ ID NO: 2231 - DNA, 568 bp, Homo sapiens
gtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctc

SEQ ID NO: 2232 - DNA, 623 bp, Homo sapiens
atcttaatagctgcacagtgtctgactctgttaaaggtgctcagaatgaatcttagaatattaatgcccatattttatgccatagcctctagagaggtgaaagagaagtccaaagatgggcagggttgctgagccaacatttctaaggagccctttttgtccgattcacctgccatctgcagccagcctccatataaacaccttttgtgatcaaccctgatggattatttgttagtttatttgttgggggaggggaataaagagaggaaaatgtgggagtacatgcgaatttagggtgaagcaaaagatttttagctacacagatcaataccacctttttctagctttttgataagaatgccaaatagaactgagtcaaaaatatcattgatcaatggattgtatctattgcttttcccttttctgtatggttttccactccaccagagatgaaaattaaattgacttgtcactattttctcctcatataggcattcatcttgctcagggctttatttcttcaaattattccaatggcttacttaacagatgtagtttctttcttagttaaatcaaaaggtatttattgagcaagtactgctaatactaccactgctactgct

SEQ ID NO: 2233 - DNA, 466 bp, Homo sapiens
agttccaagaaatctataaacccgaagcaaacggtagcacatgagaaaactggagatggcacgtggatggtcatttaaaatttaatagttccgtactcatgtgaatgtacgttaggaaaaatataacaagcacattgtcgatttcgtgagtattattgcttaagatcgggttaagtaataagtaaaccaattgaatattttatttcagttgaaaagaaaaatactgaagaattttaatgcctttaatggggtacttgagtatggcaaaaatcgggaaggctgagagtgtcatttgggagctgtgtcccaagtccctcgtgggcctttaatcagcagttacagatctgcagctcctcctgtaggatggaagcactttgctctttggccttttgaggtcacccagctatttgaaggtcaggggcgactcgattctaatgagatcaaggtcacagggtcatgttgcccc

SEQ ID NO: 2234 - DNA, 546 bp, Homo sapiens
  misc_feature 441: n = A,T,C or G
ggttgtgtgggttaaaattaccctagaaatcaggtatttccaaatcaatgagtaaagctgtattttaaatattttgaaggtataaacttgggggttttgtttggtggattattgtgtttgggtttttttttctttttcttttctaaaataacgaagcccttgatcaagcagtaaaaccttaattatgaccagaagtacaagataacacatgatagtaataccattgcattatgcacatggctcttgttacatgtttggactacacatgtggcactagagataatacaagttttctcatttgtatctctgtcatgtacaccaatgcagtgatctttttcaaatgcttggtttgattgtctctaagcccttcatgctaaagggcaattatactactttgtgatagtttttttccccccactttgtcacccaggctggaatgcnagtggtgtgatcttggctcactgcaacctccgcctcccaggttcaagcctcctgtctctacaaaaactgtagccaggcgtggaggcgtgtgcccatagtcccagc

SEQ ID NO: 2235 - DNA, 544 bp, Homo sapiens
acagaaggggagtgtggagaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatc

SEQ ID NO: 2236 - DNA, 411 bp, Homo sapiens
atggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatttaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttat

SEQ ID NO: 2237 - DNA, 435 bp, Homo sapiens
aggataaagcctgtttttctttcctttatttcccagggtttaacaaataaatgcatatattctctccaggtggggaagaaaatcagcctaaacaaattaaagtggcagttgcttatagttaaggttgagtcagtttttccattgcatacaatgttttcaagaagcttagttcccagagaatttatggctcccctataaatatttactttgcattgacagcaaagtacttatatttttgcagcagagtgccaacataagccttttgcctactggtatcttagtctttaaaaagctaaattttgagaattacaggtttgagcgaaatctagaaaattcatttagaaataattaaaatgtgagggataggagaaacataaggaatcatttggtctctcagttcttcacattctgcatgctctcttttctccccccttc

SEQ ID NO: 2238 - DNA, 417 bp, Homo sapiens
tataaagtaatgtagggttatatttgggagtgactgcaagcatttttccatctgtgtgcaactaactgactctgttattgatcccttctcctgccctttcccaggtaatttaaattggtcatggtagatttttttctttgatgggaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgc

SEQ ID NO: 2239 - DNA, 205 bp, Homo sapiens
ctaagcagtctgacttacctgttgggaaacaaagggatattgctctaagattgattaggatgattgtagctagagtcttgaattctatctgtatacggcagaaaaactttatagagtgtagagaggtgagcgaaaggatgcaaaagcactttgagggctttataataatatgctgcttgaaaaaaaaaatgtgtagttgatactc

SEQ ID NO: 2240 - DNA, 456 bp, Homo sapiens
tacggctgcgagaagacgacagaaggatacggctgcgagaagacgacagaagggtacggctgcgagaagacgacagaaggatacggctgcgagaagacgacagaaggatacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagtacgggaaggcgaagaaaagaatagagaagatagggaaattagaagataaaaacatacttttagaagaaaaaagataaatttaaacctgaaaagtaggaagcagaag

SEQ ID NO: 2241 - DNA, 553 bp, Homo sapiens
aaatcagatgtcataaagtctttaaaaagcagaattactttgaaaataaaggtattattattatagaattttagagattaaagaaaaaacagaaactaacatttaatgaagacctactctgtgccatgccatgtgcttagaactttgtttaagccatttcatttaataacctttcaacctaatgaagcaatatagcatgatggttaaactctgtgggctataggctgtcaagttcagctgcacagcggctaactagctttatgacttttcaaatgtttatcttctttttggcttagtttctctgttacaaagtggcaataataataatagcactcacttccaaaagattgttgtaggattaaatgattggataggttcaaaatgttaggaacagtagtattcaataaacatagttattatttgctatctttcccactactccataaaccctctattaaaatacaaatccacattgattttaactgctttggtgtagaagtggattctaagaagagggcatgtgaaataaatggaaaagccaaggattttatgt

SEQ ID NO: 2242 - DNA, 301 bp, Homo sapiens
ggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgcgtcgggtaatgcgtgtggctgaatgggcataaccactgtggcttcttgtgctgtaaaagctcgttgacaagactg

SEQ ID NO: 2243 - DNA, 204 bp, Homo sapiens
tgttgagtgagataagactcttgatatgttagaagaccactgctctaggatatgtgtagaaacagatctgacacataggaagtacttaatgaatgtttgatgaatgaataaattttcaggcctgcctgacatatctatgtgacatgtgtcgacacatacagcccctctggtgctcagtatcatattctgaaaaatgaaggtgtt

SEQ ID NO: 2244 - DNA, 452 bp, Homo sapiens
ggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccac

SEQ ID NO: 2245 - DNA, 507 bp, Homo sapiens
tacggctgcgagaagacgacagaagggatctattgcttttcccttttctgtatggttttccactccaccagagatgaaaattaaattgacttgtcactattttctcctcatataggcattcatcttgctcagggctttatttcttcaaattattccaatggcttacttaacagatgtagtttctttcttagttaaatcaaaaggtatttattgagcaagtactgctaatactaccactgctactgctggtactgttaatactactgtctctactactgcaatgactggtctcatagtgttttaggctgccttcaaggtgcatcaccttatttaaattgtacaacaaacccttaagttatgtacaattatatgaggaactaggcctcaaaagttttataatttcctccagctcgtagtggcagggctggactccaagctgagatgtgtctggttgtccggttctaaacctttctacaggtcgccttgtaaagaataaggatggagctc

SEQ ID NO: 2246 - DNA, 525 bp, Homo sapiens
aaccacttctgtattgtgtggtcttaactgcctaaggcggcaatgggcagtgggcccctttccctttagatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaatccagggaaggtggtgggagatgagtcaaagctaagtagtggaagctgggcacagtggctcatgcctgcaatcccagcactttg

SEQ ID NO: 2247 - DNA, 52 bp, Homo sapiens
ctgccctggaaactaacggctggagccatcaacgccactgaactctttgggt

SEQ ID NO: 2248 - DNA, 191 bp, Homo sapiens
ggaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttacttttttttttttttt

SEQ ID NO: 2249 - DNA, 552 bp, Homo sapiens
ggtaagaatagatttctcatggctctaaaaattattcccaagaataccttacttggttcaaaagcagactgtttctctccatttcatctcaaatcagacttctgggcaagatgttctttagagtaagcaaacctacaacctaaaaatctcttcaagaggcatctctggtcttgtgacaagacctcttcaaaaacccacagtaaaactcccctccctccagttggccaccagtctgccaccaaacatgaacaaattctgctgctaatcggtttcccttgtgatctggttcctgaggtcttcggatctgtgcaatgaattatttattgttttattaaaccgacagtggtgtcccagagaggaaccataaataaaatggaaatctggtgctgtgataaagtaataactagcattaatgagacctggttttcctttcagaaagtccagtatacctgtaacaaaggttaaagcaatttatatttaatttgcattctgatgttaacatttaaacagcaattctaacaaaatgcatcgagtctaattcttacctctatc

SEQ ID NO: 2250 - DNA, 339 bp, Homo sapiens
tacggctgcgagaagacgacagaagggtacggctgcgagaagacgacagaagggtacggctgcgagaagacgacagaagggtaaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttatta

SEQ ID NO: 2251 - DNA, 596 bp, Homo sapiens
agcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctga

SEQ ID NO: 2252 - DNA, 566 bp, Homo sapiens
actttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaacactctacacctc

SEQ ID NO: 2253 - DNA, 579 bp, Homo sapiens
gtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcagactaagcctacctgctctccaagtctcagtggcttcatctgtcaagtgggatctgtcacaccagccattcttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacagactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgc

SEQ ID NO: 2254 - DNA, 103 bp, Homo sapiens
tctgggtagtccggaaaacaaaaggagggaagacagcctggtaatgaataagatccttaccacagttttctcatgggaaatacataataaaccctttcatctt

SEQ ID NO: 2255 - DNA, 303 bp, Homo sapiens
ggtacactgggctctcaacgtggtgtggaaggtagcctgttacagtgctggattcataaaagggcctttatggtttgtgaaagaatatctgtgtgcttagggagggaactttttgatctgcagaaaagccagaagacatctaggacatccataaaaattcatcagagagcattttactactgagctgcaaaggtaggaaaaataaattttttttggttagaaaatatacttctttcatctgcgtttcaataatttattccccttgttagatatacatggaattgatattgcttattctgacta

SEQ ID NO: 2256 - DNA, 226 bp, Homo sapiens
gaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtaca

SEQ ID NO: 2257 - DNA, 353 bp, Homo sapiens
atcctccctgaccctgctcctagcaccctggagagtgcacatgccccttggtcctggcagggcgccaattctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctg

SEQ ID NO: 2258 - DNA, 507 bp, Homo sapiens
atgtttaatgaattcattttattttataaggctgagtacatatacagatgatcccattttagtttctcagctattttactatatgttaaatattttgatgctgtatttacatattagcatcagcaaccataatttttctgataacttttcaagatcagccaaatcatatccttgacaagtcacactttttctctgaagttttccataaaacccaaattaaaagtgatctgacactggtagcattttacaaatctaccttcatttagcatttatatatgcttttaagttgaagttttttctatatatgaaactgcaagtggttagagggcaggttttgtgttttaggtttgttaatttctctcccaaccagtgtcagattggctcagtctgagtggaggatcaatgaataggtgatgaatgaatggatatctacatgtcagtgcattgacagtgaatacatcttgcttatcatagtgaaagaaacagccggacacagtggctcatgcc

SEQ ID NO: 2259 - DNA, 349 bp, Homo sapiens
acgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggagacttttttcagataacatcttctgagtcataaccagcctggcagtatgatggcctagatgcagag

SEQ ID NO: 2260 - DNA, 357 bp, Homo sapiens
gagtgcaaaactctcctatagctcctatacaagtccaggatttgctattagactccttgaattatgtgcccagctctgagccaatggctgtgcttaggaggctcctgtctcatgcacccaccccagtactgggcatcagaaacaaccagtgatccctataatgaaccacgggttcacagacttaagtgtaatcctgcagcagggcctcaggaagacttgaaacccaaaatcagaaagccatggtttcttgtcttcctggtgtctgttttgtcccttccctctgtagaggagtcctgctatcactgcaggcaacggggctgccctgcagctcctgctgtttacatttcactcggtgta

SEQ ID NO: 2261 - DNA, 469 bp, Homo sapiens
gctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgatacctggctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggact

SEQ ID NO: 2262 - DNA, 371 bp, Homo sapiens
atggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagccccc

SEQ ID NO: 2263 - DNA, 502 bp, Homo sapiens
ggttctccaattaaagctgttaacgtgtactacgctgtttccttgttggattttcttgttccctgctgctactgtaaaaacgaaatgagtggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatatgctcactctacacatggaaggtccaactttagagatgaacgatctagtaaaacatatgaacgtttgcagaaaaaattgaaggatcgccaaggaacaca

SEQ ID NO: 2264 - DNA, 172 bp, Homo sapiens
ggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaa

SEQ ID NO: 2265 - DNA, 602 bp, Homo sapiens
gatatttaaaggtttgccttttgcttctcgtgggtacaagccagagagagcagtggttacatgggggtagaatggtgactcgtttttacctgactgtggatcagctgggtggttcctgaatctcactgggctcattgtggctctttgcttgtcctgtatttactgtctgtggtagtgagatagaagaaccaccatgttcttctggttctagactcaaactacagggagaaggaagagatgtgtctggcatcatttccgtgttggagtaactttgtggtagattgctgtggcctttctttgtggcctgccacttgtcttacattcttcagagcatttatgcacaggagcataaatatatgattttcatcttgccattgaaagtagactttccggccgggcgtggtggctcatgcctgtaatcctagcactttgggaggccaagggtgagcagataacttgaggtcaggagtttgagaccagcccggctaacatggtgaaaccccatctctactgaaaatacaaaaaagttagccgggtgtggtggtatgcacctgcaatcccagctactcagtaagctgaggcaggagaatcgcttgaacctg

SEQ ID NO: 2266 - DNA, 579 bp, Homo sapiens
attaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggc

SEQ ID NO: 2267 - DNA, 235 bp, Homo sapiens
acgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggctctta

SEQ ID NO: 2268 - DNA, 596 bp, Homo sapiens
acagaagggaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctaacatcctcttcacccaggaactggcccggagactaaaaggctctggcgttacgacgtattctgtacaccctggcacagtccaatctgaactgggtcggcactcatctttcatg

SEQ ID NO: 2269 - DNA, 59 bp, Homo sapiens
gtgtcactgcactcagttgctggcttccacttcgggcttcctttccacagggtcctatc

SEQ ID NO: 2270 - DNA, 262 bp, Homo sapiens
gttctagtgagtgtatgagaccttgcagtgagtttatcagcatactcaaattttttttcctggaatttggagggatgggaggagggggtggggcttacttgttgtagcttttttttttttttacaaacttcacaaaaaatgcagtggttttgatttaaggtttgtttgttttgtgggcaaaaaaaggcaaaatggttttgaccccgttgtttttaaaaggcttgggaaaacaacgggggtttaataaaaagtggggtccccc

SEQ ID NO: 2271 - DNA, 350 bp, Homo sapiens
gctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgc

SEQ ID NO: 2272 - DNA, 547 bp, Homo sapiens
agttaaaggatttgtccgagaccctcaaggtaacccaattgcgaatgccaccatctccgtggaaggaatagaccacgatgttacatccgcaaaggacggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttaaattttgtgcagttaatacttaacattgatttattttttaatcatttaaatattaatcaactttccttaaaataaatagcctcttaggtaaaaatataagaacttgatatatttcattctcttatatagtattcattgtcctacctatattacacaaaaaagtatagaaa

SEQ ID NO: 2273 - DNA, 583 bp, Homo sapiens
gaacacccaacacccatgagttcagtccttaagaaggaaaattgagcaagtatttaattggttggacattgcataaaagaggtccatatccaggctaactctagaaattttattctcaaacttagttggcctctttttcttctgtcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccataaaagctggtgacatgttcctggaagctctgggctacacctggcatgacacttgctttgtatgctcagtgtgttgtgaaagttt

SEQ ID NO: 2274 - DNA, 496 bp, Homo sapiens
atgagcatgccttgcaggttaggcctgtgcactgggaaaggccaaccagtgcagcttaagaggcacctattgcaagggaatgtccccagcaggggaccctgagttccccaatgttaaacagagcatctgggtgaaaagtggtagttcacttcaccacgtggaaacacatttgtatactaagtcctagcacaattaaaacttctcctttgaataggctagggtttgtttctacagaaagtgtatcgtgttgaattctgaggcagagttcatggaaatcagaggcattgccagggttcttaagtgggggccatggctggatttggagccaactttcagtttgctcaataatgtggtcgaagagttacaggtgagaaaaacgaatgtgcttactgaagaatttctaaatccatggctccctctggcggtcctgccaagaacatgacacaattaggacacaattggcatctaacagacaagcctgtgtccctgctgaaca

SEQ ID NO: 2275 - DNA, 434 bp, Homo sapiens
agaacacgaagagggagccatctgccacactctggaggctgaagcctgcaccagtgctgctcgcctcactgtggtaggtggtggtgatggaaactgcagatcggccagagtggtagaaaagttgctgcagggtttttctggctttgcctgcccagccgctccatgcctggctagaggagaaggaggagccacatgtggtacactggaggctggagcctgcagatggcatggctctgcggctcaccttgctgcagttggtggtggtgacagagactgcagcttgactgtagtgaatttggaaattatctgtctggaagctctgagtttatcttgggacctcaagaggagaggatcacccaactcacagcaatcaaactccaaatggtgctataaactgaaccacacatggacacgtcagtcttccgaggaccctt

SEQ ID NO: 2276 - DNA, 57 bp, Homo sapiens
acagagggggaaggggttataggatggtgtgaaaaccctcagtgagaaagttgaaag

SEQ ID NO: 2277 - DNA, 569 bp, Homo sapiens
gacagaaggtctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattggttggtgcaaaaagcacctattataccaggactttaaaaatcagtctgataagtctttgataagtctaataataataactgataagtccattgaatttgcttctgattactttt

SEQ ID NO: 2278 - DNA, 428 bp, Homo sapiens
ctcaatgctggctgctgctaacattaatgagaaggtggccttcggtgtccacctgtggaacccaggacacagcacctgactgcacacagtggctgaaatccagcatttttacataggagatgcacttagcctctaagcctcgttttactcatctgtgaaacagatataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatc

SEQ ID NO: 2279 - DNA, 528 bp, Homo sapiens
agaagggattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacataactggtgcttatgccgagttatttgcgatgagtaaatatttagtttctttttcttcatatttataatgttgatctggcatcctcaggctgcaactttattagcttataacttactcatctctatctttaccaacaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcat

SEQ ID NO: 2280 - DNA, 557 bp, Homo sapiens
ggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaatttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagctatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaaacctctcatgtgtatatagtatttccttgtataagcac

SEQ ID NO: 2281 - DNA, 532 bp, Homo sapiens
acatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttat

SEQ ID NO: 2282 - DNA, 379 bp, Homo sapiens
gctttcggagggtggtgagctagtctgcggacgctgtataccctcctccacttcccgctgcagccaataaaggccgttcctaccatagtctgtgtccgcgttcttttttccgggactgcagagttcggggaagctgtacgccgcctttcgctacgcggaatttgcagatcttcccctggacctcaggcctctccggctggagtagggtggacgcttcacataagcttctctggtcgaacttgcccgaatctccagatggccgcgctgcgtcgaatgctccacttgccgagcctgatgatggggacgtgccgcccctttgcgggctcactggctgatagttgcctggcggaccgctgtctctgggatcggctgcatgccc

SEQ ID NO: 2283 - DNA, 513 bp, Homo sapiens
cattgctgtggccctcactgtgtgactgctatagcaccaacacacctttgttgagtttatgttttggggaaggttgatctcaagtgtatttgtttaaagactccacccaacgttcactcttggtggtgaaggcaggggacacaactctctggatgttggatttacagcattagtaagtctgttcaatataatttaaagcctgattataaatgattttaggatgtcttaatgtttctgttcctaaagcctttaagaaaagtccatagatttcatctgcattttccatacagggtgcaggtgataggtgatttgaatacttgctattttgtagcctttcccattctgaaattcactttcagttcactcagagatgtaggtgaaagacagcagtggcagtgaaggaaagtgggagaatgaaaggatcagagtgtggagagatgaccacagccactgaggcaggtgtgctgttgttacttttgaaaagaaatggcaggcaatcagcttgcatttcct

SEQ ID NO: 2284 - DNA, 402 bp, Homo sapiens
gacagattcctcttagtcaagtcctgattaaaactccagctaagacattagtaagccttggttagtgaagtggcatcaggaagtgcctacattttcatggcctggtagcgttcagtgaaaatgttcattaacagacacaggccattcagtcccgaatcccaagacactgaagactctgtttgaatcagactcacgggttccttcctagccactctcagggacaggaatgcttctggtgaagaagttttcggtggtggttcatggagcttccctacaccaacttggaaatggcattcattttattggcttttgttatcttttccttatttaccctggcttccatctacactactccggatgacagtaatgaagaggaagaacatgaaaaaaagggaagggaaa

SEQ ID NO: 2285 - DNA, 585 bp, Homo sapiens
attttacatctataagtgaaaccttgttatccccttcatttgaggaaatccaaggagttttaaacagctctactttactggctatctctatacttaagccactagttggtttttggtttgtttgtttttagcatttaatattagtgtgtgttttcccataacttaattaccaaattaataaaagggtcattcttcactaagtatcacagtagtagtgagtgaagatagtcattctacccaaacagcctttgttcgataaggttaagtgcagtaaccagaagttggaagtatagaagatgtgctttgaaaatgcatgctagaagacttcggtcacagtgacatgacagaggattgttggaaaataacatttgaagtcaaactttcctgaaagcccaggcatgaggcaaggctttctggacaaaagtttccagcagaccacagtctgacacaccatcatgaacaagatcagattttaagcctccaagccaatcaagaaattaccttgaaatgtgcgcagtgtattttaagtaaaaccagtctctgtaggcactcaatatatgtttgtttaatgtaattaaatttgaa

SEQ ID NO: 2286 - DNA, 453 bp, Homo sapiens
gtactagttttatagttcgaggtcttggctttacatctttaaacaactttgattttacttttgtatttggtgatagatactagtctgttttcattcttctgcatatggatatccagttttttcaataccatttcccaccagtgtatgttcttggcacctttgtcaaaaatgagttcactgtaggtacatttgtacgtttgttactgggttctctattctgttccattgatctatgggtctatttttatgccagtaccatactcttttggttgctataattctgtggtataatatgaagtcagaaaatataattcctccagttttatttatttatttatttttgcttaggatagtattatttcttatagtgaaagcattctatgttatttattattagtctaattttgtagttttacaatgctatcctcttttacaagctatgatcaactcagt

SEQ ID NO: 2287 - DNA, 512 bp, Homo sapiens
gtctcaagaaccagaaataaataaggatggtgatagagaggttgaagaagaaatgaagaagcatgaaagtaataatgtgggattactagaaaacctgactaatggtgtcactgctggcaatggtgatgatggattaattcctcaaaggaagagcagaacacctgaaaatcagcaatttcctgacaacgaaagtgaagagtatcacagaatttgcgaattagtttctgactacaaagaaaaacagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcacgtcggattcccagaaaacctgactaatggtgccactgctggcaatggtgatgatggattaattcctc

SEQ ID NO: 2288 - DNA, 293 bp, Homo sapiens
tacggctgcgagaagacgacagaagggtacggctgcgagaagacgacagaagggtacggctgcgagaagacgacagaagggtacggctgcgagaagacgacagatgggtacggctgcgagaagacgacagaagggtacggctgcgagagactaccgaagggtactgctgccagaatacgacagaagggtacggctgcgagaagaccacagaagggtacggctgccagaagacgacagaaggatacgggtgcgcgaatacgacagaagggtacgggtgcgacaagacgacagaa

SEQ ID NO: 2289 - DNA, 545 bp, Homo sapiens
gttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctcctttctccttcaaggttctttccccctcagttttgttgttgtcttactctggagatgccaagtgtattttttctttctatgtaat

SEQ ID NO: 2290 - DNA, 499 bp, Homo sapiens
gtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcact

SEQ ID NO: 2291 - DNA, 596 bp, Homo sapiens
gacagaggggcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactga

SEQ ID NO: 2292 - DNA, 422 bp, Homo sapiens
gttatttgaaggtgatgtttgaaagattttctaactgtgccttttagttagtcttaaatttctaattgtagttaaaaacatgccattctcatttctgacattttaagtatatggtttagaagtggttagtatagttctattgttttgcagtaggttttagataatttgtgtcttacaaaagtaaaagtgaatactcattacttatgaaagaagttagttagcttgccttaggtagatagcaagagaagagtccctggaaagtccctggtcagtgcctcatccctgcataacatataaagaagcctggaaaaaatcaagctgcagacactaacaagggaactagcatatgttgttgtgcttggggacatgcccgtggctgcacagatagaaaaacctctggcccatttggataaaaacttgta

SEQ ID NO: 2293 - DNA, 270 bp, Homo sapiens
ggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatg

SEQ ID NO: 2294 - DNA, 269 bp, Homo sapiens
gaaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaagcgggatgacttttgtaaacagaatcaggaagcatcatcagatcgttgctcaggtttacttcaggtcattttcagtcctct

SEQ ID NO: 2295 - DNA, 227 bp, Homo sapiens
gattaatggagaagtctatggggtcacgtggaaactgtttaccttgccacctctctgtagtcattaaaactcttgaaaatgaattttcttatcctaagagtgtaaaactgatgttgtggagcattttgcacatgccagacacagatgaattcaagacgcagtccctacactccgggtttctacagtttagctggacagagatgaacaaaattgcaatggagtgtgta

SEQ ID NO: 2296 - DNA, 275 bp, Homo sapiens
gaaaaagggggcggcggactcggcttgttgtgttgctgcctgagtgccggagacggtcctgctgctgccgcagtcctgccaactgtccgacaatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtacca

SEQ ID NO: 2297 - DNA, 384 bp, Homo sapiens
gaagggtacggctgcgagaacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaacgacagaagggtacggctgcgagaagacgacagaaggggaacaccgaatagaaggccgggcacagtggctcacgcttgtaatcccaacactttgggagaccaaggtgggtgatcacctgaggtcaggagtttgagaccagcctggccaacttagtgaaaccctgtctctactagaaa

SEQ ID NO: 2298 - DNA, 454 bp, Homo sapiens
ggttttccactccaccagagatgaaaattaaattgacttgtcactattttctcctcatataggcattcatcttgctcagggctttatttcttcaaattattccaatggcttacttaacagatgtagtttctttcttagttaagtcaaaaggtatttattgagcaagtactgctaatactaccactgctactgctggtactgttaatactactgtctctactactgcaatgactggtctcatagtgttttaggctgccttcaaggtgcatcaccttatttaaattgtacaacaaacccttaagttatgtacaattatatgaggaactaggtctcaaaagttttataatttcctccagctcgtagtggcagggctggactccaagctgagatgtgtctggttgtccggttctaaacctttctacaggtcaccttgtaaagaataaggatggagctc

SEQ ID NO: 2299 - DNA, 344 bp, Homo sapiens
acgacagaagggtacggctgcgagaagacgacagaagggtacggctgcgagaagacgacaaaagggtacggctgcgagaagacgacagaagggtacggctgcgagaagacgacagaaggggtttgtaggctgtgtgacagatctatactgatatttttatatgtagatagaagccatggttagtaacaaaatatgtagtttttttctaacataaatactactattatatgcatgtctggagattattttaatatttaaaaatgactccccatatgggcaaatgttgggttcactgatccgcaataagcatttcaataaaatatctcatctgtttaaggaatatg

SEQ ID NO: 2300 - DNA, 390 bp, Homo sapiens
atttcatttctaaaagaaaagccccaaaaccaagtgctgttttcctggtctgtggaaacagagtctccgaggaattaggctagacatggtaagaacaaagttctgttgtgataaaagctttggcctgaggttccaaccattcagtttgccagctcagacttgatcttgaacgaaggcggggttctgtgactggagaccatttctctccttttgtatttgttggtgtgtccaaaaacctcagatctcccagcttcaggcttctttgagggcagtgctaaattggttgaaaccttatttgaggcagttcctgaaaagggtaggtgaaatttcctgctgataaaaggcatcctgtgtcttgttcatccttagcaaattgccaattagcaaaga

SEQ ID NO: 2301 - DNA, 479 bp, Homo sapiens
ggtttttactttacccttcaggattttttacttcacaacacggaattggctatttggagatttactttgtaagatttctgtgatgctgttttataccaacatgtacggaagcattctgttcttaacctgtattagtgtagatcgatttctggcaattgtctacccatttaagtcaaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaact

SEQ ID NO: 2302 - DNA, 187 bp, Homo sapiens
ggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatc

SEQ ID NO: 2303 - DNA, 530 bp, Homo sapiens
  misc_feature 478: n = A,T,C or G
agacgacagagggggatctaacttgcttttcagaagcacgtgactggcatatttgggtcattaaatataaagacattctgcttatgaattatgccagcaagatgttttcagatcatacaaaaacaatgtgtgtggtgactgccaagtagtgtttttatgtgtatgtctgtacacaccacccactgatctatgcaaggcagtggtgctttgcactaaatgccacatcgttccttctgggatctcagaacctttcataaacagtcacttaagactctaaggagttaaataaataataagatccttacccccttgaaaagaatatgtagcctacatattgaaaaattaggcaatttagcccaaggcagaatgagcagagaaagcatgacctggtgagccagacctaagtgccagcagcaagaattttgatctgtaaacattctgatgatggcagatggcagtgcggccttgagaggggctntcagtcaatctgcaaccttttattctgtacctgataagtctctggtactgag

SEQ ID NO: 2304 - DNA, 608 bp, Homo sapiens
gtttttgctgaaatgaacaccttaggatgctgaagaatatgacccgtcccatggaaaacattcaaaaatgtgtgtagcgctttcttcccaagggtgtgtgtgcgcatattttaacactaattcactttctacttccgttgctatcctttctgtgagtctttctcagaatctcagaaaagaaactaaattgttcactctagttatcaatgctgtactctatacctggaatttgctaaaagggcagattttaagtattctcaccacagaaaagagaaaagaaaatggtaattatgtgacgtggtggacatgttaactagctttattacggtgagcatttcacagcggatatccagtcatcacgctgtacacattaaacatgtacaattgggtttttttgagacaaggtctccttctgtcacccagtctggagtgcagtggctcagtcgtggctcattgcagcctcgacctcctgggctcaatccatccttccccctcagcctcctgaaaagctggggccacaggcatgtaccatcatgccaggctaatgcatatatatttatattttttggtggagatggggttggtctcgaactctgggctcaagtgat

SEQ ID NO: 2305 - DNA, 512 bp, Homo sapiens
agcacacctgttgcccccaacagagggcagaaccatttctctttcaagcatgggctactgataaattcagctaggcgagctagttcagccttctcattaagggaagttaagagagaagtgatgaaatcttaaaaattaggagtaactggacatttcgttaagggagatgcattacttcttacagcactaggtatgagttgaagtcaatgcattttaaacgtggttttcctaaattgaagtctttaaaaaataaaactttaagaaagtatcctaaatacatatggtaaaaattttcacaaatactgctctttggccattcaagaaatcttcaaatgaaatatgatgttggaattttttctgcagcagttattctgatgtaatatacatctgccttattttttccatcactaattttttttcagtttgggtaataaaacttgttcatgaagcgtggtatatagaccatttttaaatggccctactccagtggacttcaagtccaaaatgcaatg

SEQ ID NO: 2306 - DNA, 494 bp, Homo sapiens
ggagcatcagaagttcttaaagcataagttcctggtgcaggaaattatgtttgatcgttgcttaaacaaggcgtctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagc

SEQ ID NO: 2307 - DNA, 524 bp, Homo sapiens
gagttttgcaatcaattcctgttcaaaggccaccctactcttcctatccgtctttctccagcccaaacactcacagccccctgccagaccaggggacctcggagaggcaaggacagaggttcaggatcttcctctccctcgggacccaaggccacaaaggagagctccgtggagagaagaaaatcatttgactcctggggacacagatttgctgccacagaggctgatggacaaccaggcggagagagaaagtgaggctggtgttggtttgcaaagggatgaggatgacgctcctctgtgtgaagacgtggagctacaagacggagatctgtcccccgaagaaaaaatatttttgagagaatttcccagattgaaagaagatctgaaagggaacattgacaagctccgtgccctcgcagacgatattgacaaaacccacaagaaattcaccaaggctaacatggtggccacctctactgctgtcatctctggagtgatgagcctcctgggtttagcccttgccc

SEQ ID NO: 2308 - DNA, 530 bp, Homo sapiens
aaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcctggttgagagaataacctcatagtaccaacatgacatgtgactt

SEQ ID NO: 2309 - DNA, 522 bp, Homo sapiens
gtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatccc

SEQ ID NO: 2310 - DNA, 451 bp, Homo sapiens
agtgaaaaacttggaatccagatgtggcagaatgttgctgcgtctaaaaattcctatttgtcatcgggtagtcggggttagaagtgcacaaatggcttgcttcctctcatagccaaaccagtgttcctcgtggctcaatatgacacctagatatgtaacctcttcatggaaaatttgggctttcttttttgatattttgtaacttgctttctataggagatggaggagatcctgggttccccgataacactcctctcaggttggggcaggcaaagaaagctcgtctatgtactgcaacaaggcacagttgttacttggcagggtataggccatgaggtctgaggccaatgtttctctaaagattgtgggagagaacggggcatggtggtttgcgcctctcatcccaacactttgggcggccacatggctggatcatgaggtcaggagtcca

SEQ ID NO: 2311 - DNA, 506 bp, Homo sapiens
atagtgcagttttctagcttccctttcacaaacggtgttgaagaaagtaaattaagcaactcagctatcactgggaatgcagtagaagtaatcaagtccagtgctgggagatagttgccatgatattccaacatggacaccaggatcacagtcgatgactatgccctcccttgaagatggtggcttgcctctctttctgtaagcaaatgtcatgtcataacagtattaaacaattacgagtaatgtccccatctgcttctgcactgcctttgaaatactatttcagatctgccaaaataaatggcaaactcattaacaagaaagcagggtggggggtgcattcatccctgccttcctgagtagtctattcacccaaagacaaaaggatgaccagcttccatcagggatattcaaagacacagtcaccctgccatgcagccagaggctggcaaaggtccaatcccctttttaagaagcttgttggatgagctctttaaacatacaac

SEQ ID NO: 2312 - DNA, 392 bp, Homo sapiens
cacgtactcccaaatcatcatcatcattatcgtcatcattatcaccatctgataaaattaaggaaacagtaaatcatgagaaaaaaaaatgaaagaggagattcagaaagttgtggagatgaatcaaaagtacaaaatacagaaaccctgggaatcaagattttaaaaatgctataatcagtggccagcatggtggctcacgcctgtaatcccagcactttgagagacagaagcaggcggatcacctgaggtctcctgacctcagagaccagcctggccaacatggtgaggcccggcctctactaaaaatacaaaaattagttggacgcaatggcacacgcctgtaatcccagctactctggagactgaggctggagaatcacttgaacccg

SEQ ID NO: 2313 - DNA, 400 bp, Homo sapiens
gaaaaatataacaagcacattgtcgatttcgtgagtattattgcttaagatcgggttaagtaataagtaaaccaattgaatattttatttcagttgaaaagaaaaatactgaagaattttaatgcctttaatggggtacttgagtatggcaaaaatcgggaaggctgaaagtgtcatttgggagctgtgtcccaagtccctcgtgggcctttaatcagcagttacagatctgcagctcctcctgtaggatggaagcactttgctctttggccttttgaggtcacccagctatttgaaggtcaggggcaactcgattctaatgagatcaaggtcacagggtcatgttgcccccaggaaagtgggagatggagttctgtggtccaggctgtggccctgctgc

SEQ ID NO: 2314 - DNA, 424 bp, Homo sapiens
acagaaggggaaaatggtgctgatagacttgctcaaccagggttgccacaaacctgtgatgtgtaacaaaacacagtatccgcaaagtgcaataaaacagataagggctggaggctctggagttgaaagccctctacatggcagatgatcattgaagacatgtgatgtatgcagtcactaagagagaagctgtagaagaaaaagctgagtgttggagaatgttgcctatggggtatgaagatgaaggggagctggtgactgagactgggtaggagcagtcagatgagtaggagacagaacaggagggggtggagtgaaggaaaggaagaaaagtaagggcttaagaaagacttggccattctttacacaaacaaggcagacaaattcagagcatagacctgggatagtgatgagtgggtttctt

SEQ ID NO: 2315 - DNA, 309 bp, Homo sapiens
gccccttataaaaccccttcgattgctgagacaacatattaaagccatatgctgcttccttgttggggctcctccacagtgctcccaacaccggcgacccctaggaagacggggagcaaggaggatctggccaggagtcacaggatatacacccattctggagctctcctctgttgttctagaagatgttatttgattagttggggctgagagcaggggatatatgattctgtggaaaaggtgtcagataatcaaatcaggtctgcctctgctatagccagagtgctgctgcgttaaaagggaacaaaa

SEQ ID NO: 2316 - DNA, 130 bp, Homo sapiens
ttttccatgcgtgtttctgactctgagctacagagtctggtgaagctcacttctgggcttcatctggcaacatctttatccgtagtgggtatggttgacactagcccaatgaaatgaattaaagtggacc

SEQ ID NO: 2317 - DNA, 289 bp, Homo sapiens
ggagagagcgtttcaggcttgggtcagtcttaaagcagatctcatgtggagggtttctgctaacctgcatctcttacaacacagtactagtcagtatgctgtagtattaatcagtaggtcaagttcagtgaagtaaaggagaattgaattcttgaagttcacatttaggcaaaaatttggcgttttaagaggtgagtataagacatgatctttatagaaaacgctgatgataaaaacagcgctctctgttaggtgcctttatgcttgactccattgtcatcttttctta

SEQ ID NO: 2318 - DNA, 227 bp, Homo sapiens
ggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtc

SEQ ID NO: 2319 - DNA, 560 bp, Homo sapiens
gacagaaggggagagtactttgcaaatgattatcgagtagtcaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctga

SEQ ID NO: 2320 - DNA, 551 bp, Homo sapiens
tacggctgcgagaagacgacagaaggggaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccaaaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgct

SEQ ID NO: 2321 - DNA, 297 bp, Homo sapiens
atgacatatttctgagaacactttaatatatttccacacctactggaatctaattcagtcgatcggataaaagaaagacttttttgttgttgtttttgaaaatccataatgtagcaggttctgcgctggttttttaatgtattttatttttgtgctctcctgccaaaagaaaaggctgataagtaagtacacagtacaacatgtaaatttgtataaaaatatgcttgtttagattgctctacaataactatattaaggtaaattgtgtgtgtgtgtgtgagagagagagagagagag

SEQ ID NO: 2322 - DNA, 240 bp, Homo sapiens
tggctatatgcctattctccatgtaccctgcatggtagtgctgcaaactttaaagtacatttctttcacagcagtattttttttcataagtggcatataaatctcattcaatgaaatggggaaatcacgttgagaagttggtctgtcatctcccattgagcaaagactggcaggagataataaaaataaatatgggcacacatgtattaatatacagcacgcatttacaagtttattttt

SEQ ID NO: 2323 - DNA, 470 bp, Homo sapiens
gaagacgacagaagggtacggctgcgagaagacgacagaagggtacggcgcgagaagacgacagaagggtacggctgcgagaagacgacagaagggtacggctgcgagaagacgacagaagggggctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgt

SEQ ID NO: 2324 - DNA, 445 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgaga

SEQ ID NO: 2325 - DNA, 225 bp, Homo sapiens
atattttcattctgtaattgcaccattgctattcttaattctttgtgtttctgatttaaagggaaaacacacacaaaaacagactgttgtgtaaaattgacaagaatgagtgtgaacctgacagtcagagacagaggttgttgtaaaattagcaatggaaatagctttcttctctggaggttaaaaataatgtatttacaaggaagttatttacattggccactt

SEQ ID NO: 2326 - DNA, 362 bp, Homo sapiens
agttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgagttcatactgcagcttaaaacaagcaaaatacacagatgataatatgctaaattttcctctatcctgtatatttcacaaaaaggcatatgcaatatttacatttttaatttagtttacagaatggaaccaaaatgtataaatgttatgtttgctaaaacttcacaatgtatattgggtctttgtacattttgcctgacttacctt

SEQ ID NO: 2327 - DNA, 202 bp, Homo sapiens
tacggctgcgagaagacgacagaagggggagtggagcggcggcatgcttgcagctcggcggcagcctgtgagagctgagggtcagttcttcgagtagatctcaagctgcgttttcctccttctccaaagcagggatgggaaggtggaggctactggttgaagagaagaaaggggttgggggaatgcaacacctgcaaacact

SEQ ID NO: 2328 - DNA, 80 bp, Homo sapiens
tgcaattgggccatatgctaatttgcacgttgattcaccttctttgcctttaagccttttttttcttttttttttttggg

SEQ ID NO: 2329 - DNA, 220 bp, Homo sapiens
agaatatgagcccatttgaaataaggttttaggcaattttgctgttggctctgatttgtatatagcaaatttaaagttacagagtgtttcctagatagaagattagttcatttggttcattttgtctttgaagcaagccaagctcatgagccagttggttatttgtcataaatgaacacccatcactatatgctatgttgaggggaggcaagtctgatct

SEQ ID NO: 2330 - DNA, 130 bp, Homo sapiens
tttatttatttatttatttttgcttaggatagtattatttcttatagtgaaagcattctatgttatttattattagtctaattttgtagttttacaatgctatcctcttttacaaagctatgatcaactc

SEQ ID NO: 2331 - DNA, 365 bp, Homo sapiens
actctaccgaagttttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggttcttagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcata

SEQ ID NO: 2332 - DNA, 196 bp, Homo sapiens
gctccttgaaatgggctgagtccctgttgctcacccttgactaggaaaaaccagtttctcttttattgtatgatactaatctctattctaaaaattacgatcagttctcaaccatactccaaactctctcttttccagctacctttactccctctccttcaattccactttcctatgcttactttttttttttttt

SEQ ID NO: 2333 - DNA, 192 bp, Homo sapiens
gtattctgtgagaagtcagacagatttgtggggaatggattggtttgttgtatggtatgtattttagcaataatctttatggcagagaaagctaaaatcccttagcttgcatgaatgatcacttgctaaattcctcaaggtaggcatgatgaaggagggtttagaggagacacagacacaatgaactgacct

SEQ ID NO: 2334 - DNA, 283 bp, Homo sapiens
gggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaatggtacggctgcgagaagacgacagaagggtacggctgcgagaagacgacagatgggtacggctgcgagaagacgacagaagggtacggctgcg

SEQ ID NO: 2335 - DNA, 507 bp, Homo sapiens
atacatactcctgccaaatactataaggtgtcaaaatttggcattggggtttcaaaagtataaacccagcccaaaacggaatgatctttacttgtgtaatttttaataagtaagacattgatatggggtttaataaaaacagctgcatgttgaatttagtaagattactagcacttctaatcctgcggcatttggcagtctagtccacagacaataaggtaaggactgttactgcctttgtttcaaatctaaactataaaccaggttcctctcagtgttagttcagcctatgcccaggaatgaacaaggacagcttggaggttatgagcaagatggagccagttaggtcaaatctttttttcactgtctcagttataattttgcaatggcggcttcataactttaaatcatgactatcacagatttcataaataatctagataaacaattaaaataattaggtaattgtaatgggataaatacttgtagacaaactggtcataattt

SEQ ID NO: 2336 - DNA, 147 bp, Homo sapiens
ggaaaattctgttaattatactgcccttcccctttataggttttctgtaggagttaaaatacactttttcaattgcttgacataatgctcaacactggtaggggagctaaaaatgtcagctattgtcctatgtgccaaaaaaaaaac

SEQ ID NO: 2337 - DNA, 323 bp, Homo sapiens
atatttgaagatcttcattgtatatttatacaagttagcaaatgctgcctaacaaaccacctcaaaggtaattgcctaaaacaacacacgttattactcttgagtttgtgtatcagcagaatgactcctcctgtctcagtttgccttcattgtgtatctggagtcagctgtgcatcagtcagtcaactctgttgactgcaaatttctcttgaatggactcatctgtactctcctctatacattgtctgattttccagaaggctacacagggcttttgacatagcaatgactgggttcccatggaagtgagcagaagcactcat

SEQ ID NO: 2338 - DNA, 460 bp, Homo sapiens
acgacagaagggtacggctgcgagaagacgacagaagggtacggctgcgagaagacgacagaagggtacggctgcgagaagacgacagaagggtacgggtgcgagaagacgacagaagggtacggctgcgagaagacgacagaagggtacgggtgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaaga

SEQ ID NO: 2339 - DNA, 429 bp, Homo sapiens
gacagagggtactgatttgtaaaattgtataaaaaatattaactttcaggctgggcgcagtggctcatgcctgtaatcccagcactttgggaggccaaggtgggtggatcatgaggtcaggagtttgagaccagcctggccagcatggtgaaaccccgtctctactaaaaatacaaaaaattagccaggcatggtggcgggtgcctgtaatcccagctacttgggaggctgaggcaaaaaaatcacttgaacccgggaggtggaggttgcagtgagctgagatcgtgccattgcactctagcctgggcaatgagagtgaaactccatctcaaaaaaaaaaaaattaactttctctattatacataataagcatatttcctagtttctcttgtttaattaaatagaacgttttgacataaacaatctgtt

SEQ ID NO: 2340 - DNA, 551 bp, Homo sapiens
acagaagggactatatatcactctggctagaggcgagccccgtggcagctctgtcacccaatgccttgtcttatccttcttgtaccttccccaagcatggttcgtagcatgtgcgtgcatggttcatagtgtgtgagtactaaggaattaaaaaaacaaaaagtagtagagcaggttgactcttctttaaaaataaacatattgacctgcatggaaggtgaggctgaccctccccattctccattcatcactggattcccagcagggtgtgtgaattcagtggaatgggaagcattgaccaacctctgtgtttctgaagaagtgagagcttttgtaggtgagcagataatgtatttaaatagctctaattttacagtgaaaaacacccacagtgtgacaacatggaaagaatataatcaacttcaacccaatatactcaactccaatcccaattttggcagatagaacaaaaagtcaatacatgttatctgacattaaacagagcttatggaagacagaagtgggtgaggcagataggccgtacttggtca

SEQ ID NO: 2341 - DNA, 496 bp, Homo sapiens
tagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgac

SEQ ID NO: 2342 - DNA, 93 bp, Homo sapiens
ggcaactccatccaaaacatatggatagagtggggaatcagggtactattatcagaagcaagtatatatgaatattgggcagcaagataaaca

SEQ ID NO: 2343 - DNA, 488 bp, Homo sapiens
acgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctg

SEQ ID NO: 2344 - DNA, 624 bp, Homo sapiens
gtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggccggggccgaacagagaagagagatcgtgctgttcgcctcaaggcggcaaggttacctgtctctcctttaagaaaatgcaaagaagtgaaagtggagaaacccacagcagatgcagaggcctatgttttcactcctaacatgatctgtgctggaggagagaagggcatggatagctgtaaagggacagtggtggggcctttgctgtacaggatcccaatgacaagaccaaattctacgcagctggcctggtgtcctgggggccacagtgtgtgacctatgggctctacacacgggtaaagaactatgttgactggataatgaagactatgcaggaaaatagcaccccccgtgaggactaatccagatacatc

SEQ ID NO: 2345 - DNA, 74 bp, Homo sapiens
aaacaaacaaacaaaaaaggataaaataaaagaaacaaaagcccaggtggtaaattttccagtcttcttggaga

SEQ ID NO: 2346 - DNA, 473 bp, Homo sapiens
attgatctgttaggactgcttaagagctaacttgtcacctgtgaaatggttggcttgatattttgatatttaaaggtttgccttttgcttctcgtgggtacaagccagagagagcagtggttacatgggggtagaatggtgactcgtttttacctgactgtggatcagctgggtggttcctgaatctcactgggctcattgtggctctttgcttgtcctgtatttactgtctgtggtagtgagatagaagaaccaccatgttcttctggttctagactcaaactacagggagaaggaagagatgtgtctggcatcatttccgtgttggagtaactttgtggtagattgctgtggcctttctttgtggcctgccacttgtcttacattcttcagagcatttatgcacaggagcataaatatatgattttcatcttgccattgaaagtaaactttccggccgggcgtggtggctc

SEQ ID NO: 2347 - DNA, 407 bp, Homo sapiens
agaaaagaaagggaagaactgccttcttatactacagaacatgcattagtgtgggctatatagctgtggctcatgctacccaattccagatttctttgtcctctaagagttgattgctgtatattaaaattgaacatcagaagatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactc

SEQ ID NO: 2348 - DNA, 256 bp, Homo sapiens
ggaagcacatatctttccactcagaatttcaaggggaaaatgttgatagtttttagcaaaggtgtgtccaaatctgaaagttggggtttgctttcattatttctttcttttctgtatttcttcacctatcttgatcaagaaaataaacagcttatatttttctaaatttcacacgatgtaataaaatttagaagtaaaagactaggaattctgacatggtctgtacgatggtctatacagggcattaaacaatgcc

SEQ ID NO: 2349 - DNA, 489 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatctagcagagaatggaaagtcaaatttcctgaattgctatgcgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcctatacacttacac

SEQ ID NO: 2350 - DNA, 194 bp, Homo sapiens
agtgaaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcatt

SEQ ID NO: 2351 - DNA, 190 bp, Homo sapiens
aatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcg

SEQ ID NO: 2352 - DNA, 521 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaaacgacagaagggtacggctgcgagaagacgacagaagggtacggctgcgagaagacgacagaagggtacggctgcgagaagacgacagaagggtacggctgcgagaagacgacagaaggggccttccgccacggccgtctctggagagcagcagccatggccctacgctaccctatggccgtgggcctcatcaagggccacaaagtgaccaagaacgtgagcaagcccaggcacagccgacgccgcgggcgtctgaccaaacacaccaagttcgtgcgggacatgattcgg

SEQ ID NO: 2353 - DNA, 520 bp, Homo sapiens
tggacatttgcttacatggggaacaccacacaagaccgtatgagccagtaagaagatctggctagaaactttaaacaaattgctaaaggctgaacatgggctcgcaggagagggtggcagacccggggaggtttgtactttgttgtaggcgtctcctctgccaggtgccccaagggaagacctgggagaatctcgagaagcctttcctgtggtcttgaccgaggaagttgaacagcagccactgcagaacctctagctgaacccatgtccttcatctttcctactgactagaacattaatcttcaggaaggatacagaactgcagcctgagggcactggtggatccctctagaggaggggaagaagaatggcaaccactagcaatattcaactcagaatcatattccctgtcattcctaagaaacaaatgccctaatctacaggaggaagggcaaccaagatgtatcctgaggttcctggtggaaactcactgtacccagagggggagaaaagaagaaca

SEQ ID NO: 2354 - DNA, 678 bp, Homo sapiens
gagtcagttctgagactctgcatactgaataataggtgaaataaggaaagactttgagaagcaataagaaatatatctgatttgaccttgtccattaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaa

SEQ ID NO: 2355 - DNA, 254 bp, Homo sapiens
ggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcatgtaggcataatgtgaggaggtggggagaccaccccacccccatgtccaccatgaccctcttcccacgctgacctgtgctccctccccaatcatctttcctgttgc

SEQ ID NO: 2356 - DNA, 478 bp, Homo sapiens
gagaaggacccggtgctgcaggctgtgtgggtagctgagcagagctaagcggcttgacggaccaacatctctccagctggttgaagacaagctctcagaagacaatgctgcatgtcacagccccagcaaccaacaacaccagcctgacaacttgctggggtggccgccttgtggtctgaggtggccgtctaaactatgtggtctgatctcaggctgcagaccttgcaggactgtcttcacacagactggaagtgctaacaggtggtgaggacaccgctttacaacgatgcagggggccccatgtcaccctcacccatgggaagtttgacttggtggactcagccaagccacagaggtctaacgcttctctgcggtgatttcaggctgccctggcagaaagcacagtgcctgcagacatgctgtcactgctccacacatcaacgctggcagtccttggggctctgtgtgtatatggtgc

SEQ ID NO: 2357 - DNA, 149 bp, Homo sapiens
ggagatgctggcccacggtggaggcagggagcccatgctcatggttgaaggtatgcttcaaaagtgtccttctgttgatgacttcgtaagtgccctcgtttccgacttggatctggacttcgaaactttcctcatggattctgaataaa

SEQ ID NO: 2358 - DNA, 457 bp, Homo sapiens
gaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggcttt

SEQ ID NO: 2359 - DNA, 463 bp, Homo sapiens
gggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggt

SEQ ID NO: 2360 - DNA, 431 bp, Homo sapiens
tggaaagacataaattgtaataaaaagtgttagcaccttgcacctcctgctaattgcattcctagtcaagaggaagcaaaattgtataacaaatgtcagaggtacatcatgaacaaagtgcaaagagttgtctgttcctttcaatagtgaattgaaaaagagtagcaaacctgtttaagctatgtatagtagctttaattttggctcctaacctttctgggactcatctatttcatttgtctaatgaggataatagtaacccattcaacttactgtacacagactgtactgtacacagactgtttcttcattatattcattaaagatggatttaacattaattcattcattcacccatgtattttttagtttaagaaatatttttgggccagatgcagtggctcacacctataatcccagcagtttgaaag

SEQ ID NO: 2361 - DNA, 429 bp, Homo sapiens
gccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcaaatctcagccctctactgagtccctt

SEQ ID NO: 2362 - DNA, 536 bp, Homo sapiens
atagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaag

SEQ ID NO: 2363 - DNA, 513 bp, Homo sapiens
catataaaagttttccaggccaggcacggctgttcatgcctgtaatcccaacatttggggaggccaaggcaggaggatatcttgaagccaaatgtttgagtccagtacaggcaacatggtgaaattctgtcaccataaaaaaataaataaaataaatatggctgggcatggtggttcacgcttgtaataccagcactttgggagtcggaggcaggtggataatgaggtcaggggttcgagaccagcctggccaaaatggtgaaaccctttctctcctaaaaataataacagtaaaaaatcagccaggcatggtgctgtgcgcctgtaatgccagctactcaaaaggttgaagcaagagaattgcttgagcctgggaggtggaggttgcattgagctaagatcatgccactacactctagcctgacccacagagcaagacactgtcttgaataaataaataaataaataaataaataaagttagccaggcctggaggtgcatgcctatagtcct

SEQ ID NO: 2364 - DNA, 185 bp, Homo sapiens
gtgggtttccttcttttacatccttgcgcattgctatattgatatggataattagattctaaaagtaaaatcactgggacaaaggatacacacacactacacacacacacacacacactcttttttgtgacaggatctgactctgacacccaggctggagagcagtggcgcaatcacagtttact

SEQ ID NO: 2365 - DNA, 463 bp, Homo sapiens
gtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttga

SEQ ID NO: 2366 - DNA, 568 bp, Homo sapiens
tacggctgcgagaagacgacagaagggtacggctgcgagaagacgacagaagggtacggctgcgagaagacgacagaagggtacggctgcgagaagacgacaggagggtacggctgcgagaagacgacagaagggtacggctgcgagaagacgacagaagggtacggctgcgagaagacgacagaaggggacgcaagagtgcgtctcggacagcgaatgcgccgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttccca

SEQ ID NO: 2367 - DNA, 380 bp, Homo sapiens
acacacacacacacacacaaagacacacatggagggagaggaagtaaagattaaaaagcagcacatagtgtatcggtaggcaatgggaccactagggattttcatattcttttttattttcttctttatactgcttacattttgagggttatataatgagcatgtattacttctgtaatcaaaaaaagggggtataaacctgaccttaatataataaaacaaaattactggccaggcacagtgtctcatgcctgtaatcctaccactttggaaggctgaaactggtaaatctcttgagctcaaaaatttgaaaccagcctgagctcagtgagacagtgagacctcgtctctggaaaaaatacaaaaattagccaatgata

SEQ ID NO: 2368 - DNA, 309 bp, Homo sapiens
agcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggc

SEQ ID NO: 2369 - DNA, 482 bp, Homo sapiens
gacagaaggggggcacaaagctggaataaccctgccagttcttagaagctttaagattcatcgtcttgaacttgatacacatagtatagcaccttaaaaacgaatcatctgctagttcagtattttctacttacaatcactccctcccagggcatgtaattaatttactgagcttaaaaaaaatatcaggattactcacacagtcttgaagatgcaatgtcagctatttaggacagaaacatccaaggccgtgtcagaactcaattacgactacatatgcattaaggcaggaactggcaggcctcagggtacgccaactataggactcgtgcttctcgtacgctgggctataatctatgaaactgagctccagagccagccaatcacttagctcctcataacaagtctaactggctctggaaagctgaaagggctgcactggaacacacagatgagatattctacacattaatctacttatc

SEQ ID NO: 2370 - DNA, 494 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaa

SEQ ID NO: 2371 - DNA, 317 bp, Homo sapiens
gacagaggggacaaaattagctgggcatggtggtgtgtgcctgtagtctcacctactcgggaggctgaggcaagcttaacccgggaggcggagattgcagtgagctgagattgggccactgcactccagctggggcaagagagcgagactgtctcaaaaaaaaaaaaaagttgggaagggggaaggggccacctggggggaaaataatttggggggttctttaaggccttggttgtttcctttaaaacacccttttttattttttaaaccccttcggccatttaaattaaacccagtggttggggattttattttta

SEQ ID NO: 2372 - DNA, 181 bp, Homo sapiens
ggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgac

SEQ ID NO: 2373 - DNA, 460 bp, Homo sapiens
ggctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctcttt

SEQ ID NO: 2374 - DNA, 574 bp, Homo sapiens
ataaaaagaaaaacctggctctctgcttaaggccaagaaacctggcattaatggaatcaggaaaagaaaagcagttgccacaaatcaaatcctttcatagggtatatctgtctgttattcctttgacatctgaaaattgccacatattgggaaagagaaatcattgcctttcttcatgtccctccagcacagttgtttctgagctgcgctgtctctaactgccagctcatgtacgctccttccagagagtcattctgtctgcacttagaggaaagaaaacatggactccttgacaccacgtctctgaggactcatcttgtgtcttccatcctggcacaagaaccaagtgtaccagacagcctttgaggctgaaaagagatcgaggaacagcaggggaaaggcaaatagcacaatatttgtttccacaactgatgtcactacaatgaatatgaaactcagaattttctgttaagtcaagcactagctgaggttgaataacatgctatgacaatagtggtgctataaacccaaggacattgttatgagttttcacattaaaaaaatggctggaaac

SEQ ID NO: 2375 - DNA, 522 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgca

SEQ ID NO: 2376 - DNA, 285 bp, Homo sapiens
taatgcgttcggtgatttcagaaagctagaaagtgtatgtgtggcatttgttttcactttttaaaacatccctaactgatcgaatatatcagtaatttcagaatcagatgcatcctttcataagaagtgagaggacggtgacagccataacaggagtgccacttcatggtgcgaagtgaacactgtagtcttgttgttttcccaaagagaactccgtatgttctcttaggttgagtaacccactctgaattctggttacatgtgtttttctctccctccttaaat

SEQ ID NO: 2377 - DNA, 471 bp, Homo sapiens
gaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgtcgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagc

SEQ ID NO: 2378 - DNA, 395 bp, Homo sapiens
atgagtgcctaatccacttgtgaaaattaaagaaaggggatcttttttatgaaaaacacctaatatggaaagacataaattgtaataaaaagtgttagcaccttgcacctcctgctaattgcattcctagtcaagaggaagcaaaattgtataacaaatgtcagaggtacatcatgaacaaagtgcaaagaattgtctgttcctttcaatagtgaattgaaaaagagtagcaaacctgtttaagctatgtatagtagctttaattttggctcctaacctttctgggactcatctatttcatttgtctaatgaggataatagtaacccattcaacttactgtacacagactgtactgtacacagactgtttcttcattatattcattaaagatgga

SEQ ID NO: 2379 - DNA, 221 bp, Homo sapiens
aagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctt

SEQ ID NO: 2380 - DNA, 457 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatcatctcagagatcaccacggactgatagggatatcaacatatcaccgtttagaaaagacttcttttttaatctatgagatgtttacactggttttgtagagaagatcaagtgacaggtataccgtaacttttttgattacacgtttatgatagattct

SEQ ID NO: 2381 - DNA, 500 bp, Homo sapiens
actggacagtggaacggcagattttactcaggactgttgcagtagaggaaatgaaagctcagtgtagaactgggctccactccaaatacagcacaggcaagtggggatatatagccaaggagcaggctgggtttggtggatggaaaatcatgaagaggaaccgtcagaggtgagggagattctggctaaaatgacctcacaggattcttgctgaagacaggccagggtgaccaggcatcacctgggagatggtgagggttgaggaacctgagaagatactgagcatggccagatttagccaggtttttgggaaactgggctcttgaggacagggcccaacagagagtggctcctaagaacctatctagagtttggtcaaggagagagtccttgtcaaaaggctaaactcaaacatagctcatttcattatttatttgcttacttgtctgcctgcagcaggaaataatatacctagggaaattacttctttctatccctat

SEQ ID NO: 2382 - DNA, 413 bp, Homo sapiens
acagaagggtacggctgcgagaagacgacagaagggtacggctgcgagaagacgacagaagggtacgggtgcgagaagacgacagaagggtacggctgcgagaagacgacagaagggtacggctgcgagaagacgacagaaggggaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcacgcccaagaagaaagtcttcgagaagttgcaggctgactacaaaatttctgaggagtgcatcgcacagtggaagcaaaccaacttcatgaccaagctgggct

SEQ ID NO: 2383 - DNA, 664 bp, Homo sapiens
gacagaggggggtgtgttacctgcccaaagctaatgcgaagcaaggtccagctgttccgcccgtcatacaagcttatggagcagccccctttgaagatgtccaggtggacttcacagagacgccaaagtgtggaggtaatcgagtgtggatcaaggactggaacgtaacttctttgtgcccacggtggaaagaccgtagtctgtcgtcctgaccactcccaccgctgtgaaggtagagggaatcccagcctggatccaccacagccgtgtaaaacctgcagcacctgaaacctgggaggcaagaccaagcccagacgacccttgcagagtgaccctgaggaagacgacaagccctgctccagtcacacccagaagctgactggtccacgcacggccgaagcatgaggaagctcatcgtgggattcatttttcttaaattctggacttacacagtaagggcttcaactgaccttactcaaactggggactgtttcccagtgtattcatcaggtcactgaggtaggacagcaaattaaaacaatctttctgttctatagttattatgaatatatgggaatgttaaaagaaacttgtttgtataatgccactcagtacaaggtatgtagcctgggaaatgaccgacctgatgtgtgttataacccat

SEQ ID NO: 2384 - DNA, 203 bp, Homo sapiens
gataggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctc

SEQ ID NO: 2385 - DNA, 373 bp, Homo sapiens
gattcggtaggtctgggatggtgatggggatgggacctcagaatgtatattgctaacatgctcccaggtaatgctgatgcttcaagtcttggaaccacacttcgagaatcactgttataatgtacagcagaactgcatgatcaggtaagtgtgctgagctgttgatcctcctcattcctgagctgggtgtgtagagacaagagcaggagactaggggctgatgatcttttagtcacatccatttaccccagagtgctctatacaaatagcatttttatgtattccccggcatgaaaaagctggaaagcaccaagagaggttggtgttaaacaacatgaagttttggaatctcagaaagtctgaatgagttaat

SEQ ID NO: 2386 - DNA, 388 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaacgacagaaaggtacggctgcgagaatacgacagaatggtacggctgcgagaatacgacagaatggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgag

SEQ ID NO: 2387 - DNA, 230 bp, Homo sapiens
gagtgcctgacctcaagtgatctgcccccccgacttcccaaaatgctgggactactggcatgagccagtgctcctgtcctcattccattcttcaccgtggtactgaccatccatttattcagcaccaattgtgtgccagaccttgtgtcagcattatggaggacttcccttgggaggcttgttagctgtacttgcaatctgatttgggttcccaaatcagcatataacac

SEQ ID NO: 2388 - DNA, 434 bp, Homo sapiens
caccgctgctgaccacccacactcaacctccctctgacctcataacctaatggccttggacaccagattctttcccattctgtccatgaatcatcttccccacacacaatcattcatatctattcacctaacagcaacactggggagagcctggagcatccggacttgccctatgggagaggggacgctggaggagtggctgcatgtatctgataatacagaccctgtcctttctcccagtgctgggatttctccatgtgagggggcagcaggacacccagggatctagcgtgggggaggagaggagcctaatgagaaaatgaccatctaaagcctgcccttcattggtctggttcacgtctccaaaccagcttggatggtagcagagacttcagggtgctccagccaaacgtatttgggcatcaccatgacct

SEQ ID NO: 2389 - DNA, 480 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggtacggctgcgagaagacgacagaagggatcgtggtggagaagaaggacccaaaaaagacctgttctgtcagtgaatggataatctaatgtgcttctagtaggcacagggctcccaggccaggcctcattctcctctggcctctaatagtcaatga

SEQ ID NO: 2390 - DNA, 165 bp, Homo sapiens
taattctttgtgtttctgatttaaagggaaaacacacacaaaaacagactgttgtgtaaaattgacaagaatgagtgtgaacctgacagtcagagacagaggttgttgtaaaattagcaatggaaatagctttcttctctggaggttaaaaataatgtatttaca

SEQ ID NO: 2391 - DNA, 183 bp, Homo sapiens
gagtgaataaaagcgtattgtaatttcatgtctgcttcagatcatggggacagtaccacccaggaactgctgctgaggcctgggaagctcccttgccttcgggtttggagcagtggcatcatcccaccaacctgagccatgaaagggctgagcagaaagttaaatggtagtttcctgactgga

SEQ ID NO: 2392 - DNA, 275 bp, Homo sapiens
aagatatatagtatgtaaatatattttttagacaatagcttgtaaatgcaatttaattttttttcctcttcttgctgaatttttttttttttttcaaattcgggtttttggccccacccgggggctccccccggagggcccagccttttgagaggctggggcgggcggttcccctggggttaggaccttgaaacccccctgggcaacttggcaaaaccccgtccttcctaaattccaaaatttacctggttttgttggcgtgcccctgtattccc

SEQ ID NO: 2393 - DNA, 435 bp, Homo sapiens
atttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagcctttaaaaaagaacgtgctacaaattggttctctttgagggtttctggttctccctgcccccaataccatatactttactgcaattttatttttgcctttacggctctgtgtctttctgcaagaaggcctggcaaaggtatgcctgctgttggtccctcgggataagataaaatataaataaaaccttcagaactgtttggagcaaaagatagcttgtacttggggaaaaaaattctaagttcttttatatgactaatattcttg

SEQ ID NO: 2394 - DNA, 376 bp, Homo sapiens
aactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttctcccagtgctgggatttctccatgtgagggggcagcaggacacccagggatctagcgtgggggaggagaggagcctaatgagaaaatgaccatctaaagcctgcccttcattggtctg

SEQ ID NO: 2395 - DNA, 489 bp, Homo sapiens
gctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgcc

SEQ ID NO: 2396 - DNA, 601 bp, Homo sapiens
gacagaagggggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttg

SEQ ID NO: 2397 - DNA, 510 bp, Homo sapiens
gggctaaatgacttttcttaattttaggaattatatagtcagtggcagaaaagtggccaattttttctggaatcaatagcacacaatataacctgggatcccacaggtaagaaaataagcaggattaactaaaatgaaatatcacttgcctagttgttcttatttttattactcttatgtatttcacttctgctgggtgtgaggttgtggggaataccaaagaagtaaaatggattatgcccttttagagtttatactgaaatgaagacagatatgcactgtaagaaatgagagaatgttctaagtgccataataggatacccattgtttttggaaagagatatttctctggagaattaacgtttcattgaaaaggagcctttggacctgagagtaaacagactttagcaatgagagttgggtagatggaacaggaaaaaagtgaaatttaagaaaatatatgccatgcgtggtggctcacgcctgtattcccagcactttgggaggctg

SEQ ID NO: 2398 - DNA, 414 bp, Homo sapiens
atttattcttgggtggccagttttgaaacctaaaaagggacaataaagcaaaaagtatcagtaaggataggtggctgagacccactgccctgagctactagtgtggctgtgcctgtgggtctctaaaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattatggagctgattttctagtctgtggatcagctatgcctttggacacttctcttttccattgtgccttttgaatgttgtcttctcactcagcatcagcacttcgatctaaatgc

SEQ ID NO: 2399 - DNA, 622 bp, Homo sapiens
gacagaaggatctgattagaacttccctcaatttttaaaatgcttcttgactggtttggatttgtgcaccccccacccccaatctcatatggaattgtaattgtcagtgttggaggaggggcttgctggaaggtgactggatcatagaggtggtttctaatggtttagcctcatccacctcgtgctgtctgatgataaagttctcctgagatctgcttgtttaaaaagtgtgtagcacctcccctgactcttttcagccatgtgaatatgtgcttgcctccttttcaccttctgccatgattgtaagtttcctgaggcctccctataagcataagtctgtacagcccacagaactgtgagccaattcaatcccttttctttttcaattacccactctcatgtatatctttataacagtgtgagaacagattaatacactcctcctcagaaagcattcaatttagttgtgtctaaagtatgccaggtgttctagggtgttatcttagccaataattcttcctcttcagcaagatctatttgcctatgacagcttgacctacatttcctaccatacttgtcagtaacaagtagcccataacatctgaatggacttcattgaatc

SEQ ID NO: 2400 - DNA, 487 bp, Homo sapiens
ggagatgatattcagatattctctcaaaggcaggactccaacaccgcaggtggaaaaccaacaaaaggaagaaaacagaaaggtgggggagataaggagtagccaggaaaaagaaaatagtgataaaggaagagccaaaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagaaagcctgtagctgagagacacctacatgaaatccaaaaactactggaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgat

SEQ ID NO: 2401 - DNA, 543 bp, Homo sapiens
gaatagttgaattggggctcaatacatgtttgctaaatgatgattgcatttaactgtgagcagctttttcagatattaatcaaaatgcctgcaaagactacacagttgcaagggacatcagcttatatcccaacattattggttcctgatccatagttgtgagaccttggttgattccctgatagtacagcaactccctgggaatggaagttcaacttgttggctttagaacaacataagcagtttcattgaacattcactgaatgtctcctctgtgctgagcccatgtcagggactgggtctttaatcatgtccttgtatgcagcatccctgcactctacctgcacatgacttctgaacagcatgctctgcccagacagcctcagtgagggccaggacttgaaccctgtggaagcatgtaaagacatatttccgtggtggcagaaggctgaaagttcagcatactgtctgtcttcacttttgagttgttctttcatctgcctaagactcatggcagagcactcatttcacaaactttcactg

SEQ ID NO: 2402 - DNA, 642 bp, Homo sapiens
acagaagggatgtgaaaatgtttcatttaaattatttttgtgtggcttggcatggtggctcatgcctataatcccagcactttgggaggctgaggtgggcggatcccctgaggtcaggagtttgagagcggcctggcccacatggtgaaactccatctctactaaaaacacaaaacgtagccgcgtgtggtggtacacacctgttgttccagctacttaggaggctgaggcaggagaatcacttgaacctgagaggtggaggttgcagtgagccgagatcatgacactgcactccagcctaggcgacagagtggcaccctgtgtcaaaaaattaaaaaataaataattttgttgtgtccttgttagtgtccaaaattcactggagagattctttcagaattgtaaagtttaattaaaagtgttaggtttgccgggtgtggtggctcacacctgtaatcccagcacattgggaggccgaggagggcggatcacctgagatcaggagtttgagaccagcctggcccacgcggtgaaaccccatctctactaaaactacaaaaattagccagatgtggtggcaggtgcctgtaatccttactacttcggaggctgaggcaggagaatggcttgaatccgggatgc

SEQ ID NO: 2403 - DNA, 490 bp, Homo sapiens
gagatccactgattgcaatgcaatgggacaatatctggaagcaattttatccagaaaaatcaatagctttaaaacaattcacaaccttggacctaatacctctacttctaggaagctagcctatgaaggtttctgctgaaggatgtttatcacagtattatttataatgtgaaaaagccaaagaggagacctaaaatgtttcaaagatgaaaatggtttgataaaattattttttttttgaaacaaggtctcactcttgcccaggctggggtgcagtggtgcaatctcggcttaccacaacctccaccttccaaattcaagcacttctcctgcccagcctcccaagtagctgggaatacaccccaccatgcctggctatttttttgtattttagtaaagatggggtttcaccgtgttggctaggctggtgtcaaactcctgagctcaggcaatccaccttcctcagattcccaaaatgctgggattacag

SEQ ID NO: 2404 - DNA, 463 bp, Homo sapiens
atttctgagaacactttaatatatttccacacctactggaatctaattcagtcgatcggataaaagaaagacttttttgttgttgtttttgaaaatccataatgtagcaggttctgcgctggttttttaatgtattttatttttgtgctctcctgccaaaagaaaaggctgataagtaagtacacagtacaacatgtaaattcgtataaaaatatgcttgtttagattgctctacaataactatattaaggtaaattgtgtgtgtgtgtgagagagagagagagagagagagaaacagagggagaattgactcaatgtgttttctatgaagagtcttatcttaagaatcaggtaacagagaggtcctagaccatagacccagccatcaactagcttgctgatgttgaacagatcatctctcaaccatagactgaagatggaatgaatatatcaaaagttcctt

SEQ ID NO: 2405 - DNA, 170 bp, Homo sapiens
gctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaagtttaagtcctgtctgtctgt

SEQ ID NO: 2406 - DNA, 525 bp, Homo sapiens
atatcattgcaagttttcaaccccacactaaggacatactattttatttcttcttccataggaacaatgcacctttgtctgtgtcactggatggagattttccaaccctttaccacagtagcacaactctgcattagtgcaaaatcctgggccccaaaacaatccttgttcctctcctgatggagaagtatttttcttgcatccctcccccagaagcagtgatcctttgccttgtctcaggtgggatagggtagggtatgagaggtttcttaaccttctcggaaagctgatgtgttttgctgcttcttatctcccaaaaacagtagacttttgcgtgggttcatggacacagatgctttttttgccacagaaaacgaagggttttgattcttaagagagaagcaaatgttcatgtagtcaatttttttcttatttattttttgctttgttttattatttcagtagtgatgagtatgatcattattttccacttatgccacttgcaactctaatattttgttttta

SEQ ID NO: 2407 - DNA, 531 bp, Homo sapiens
gcagagcgtgactattgattgttctttgaggccggaggaacaaagcagtcaggagcgataaaggcaggtgatccctgctggtttgccctttctcccagctctgaccgtcaccgtcacacatgacattcttgaatgaggtcacctgctcactacagattctaaaaggggcttgcttggcaaagacctccagggtcagagtgccggcctttactgtttttggcagttgtgtgcatggaacattggaagcgtttggaacggaatgcttaaggaagatattatttggcagcaagaaaaagggagtgtgcagactccccctacccctcctgggatgagtaggtactgcctgcccgttttttctctacaggagttgaatagtagccagagtacaggcttggcatcagaaggccttagttcaatccttatctcttctacctaccagcagtgtggctttatgcaagctcttgttcatctgaaccttaccgctcttgtctgtaagggatagcaatatcggttttacagagtgggctgaaa

SEQ ID NO: 2408 - DNA, 95 bp, Homo sapiens
acgacagaagggtacggctgcgagaagacgacagaagggtacggctgcgagaagacgacagaagggtactgctgcgagaagacgacagaagggta

SEQ ID NO: 2409 - DNA, 303 bp, Homo sapiens
gggcgcaatgggcacccgcgacgacgagtacgactacctctttaaagttgtccttattggagattctggcgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacata

SEQ ID NO: 2410 - DNA, 255 bp, Homo sapiens
ggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggca

SEQ ID NO: 2411 - DNA, 467 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagcgacagaagggtacggctgcgagaagcgacagaagggtacggctgcgagaagacgacagaagggtacggctgcgagaagcgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcga

SEQ ID NO: 2412 - DNA, 226 bp, Homo sapiens
tagggctgcgagaagacgacaggaggggctatctctcctagcctaaggcgtgcacacagagcgccgctgggaggctgaaacgtttaggccgatgcttgcttgcaaggtcgggcgagctggattctggtccccacctttgcagagagaacagcgatgttgtgcgcccatttctcagatcaaggaccggcccatcttactacctccaagagtgcttttctctctaata

SEQ ID NO: 2413 - DNA, 474 bp, Homo sapiens
gctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaggtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccccgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaacca

SEQ ID NO: 2414 - DNA, 98 bp, Homo sapiens
cactgaaaaagatgagtatgcctgccgtgtgaaccatgtgactttgtcacagcccaagatagttaagtgggatcgagacatgtaagcagcatcatgga

SEQ ID NO: 2415 - DNA, 427 bp, Homo sapiens
acagaaggggagcatcccgctctggtgccgctgcagccggcagagatggttgagctcatgttcccgctgttgctcctccttctgcccttccttctgtatatggctgcgccccaaatcacgaaaaggctgtccagtggggtgtgtacatcaactgttcagcttcctgggaaagtagttgtggtcgcaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatg

SEQ ID NO: 2416 - DNA, 296 bp, Homo sapiens
gaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaact

SEQ ID NO: 2417 - DNA, 356 bp, Homo sapiens
gtaacaaatttgtgtgtgtgtgtgtatatatatatgtatatgcttatatatatatatatgtatatgcttgagaaagtggtttttcaagatgtatgtgtacagtacacacatggacacgcttcagtcctctgacttcccatgtgctacctcatgtgtttctcttctcatgaggatttgcaatggatagttgtacaacctggggactgtcagtgactcattggtatcagcatatgctaaagaagctcttgaatccaatcttgaaacctgatctcccttcgtcaacattccccaataccaaactggcccgtttacccatacaaatgcacagtaaagggaagaacagcggtattttttct

SEQ ID NO: 2418 - DNA, 371 bp, Homo sapiens
atactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctg

SEQ ID NO: 2419 - DNA, 491 bp, Homo sapiens
gacactaaaactcccacagaaagggggaaaattagaaaaggggtgatataatttgactctatgtcaccacccaaatctcatcttgaattgtaatccccgtaatttctcacctggcaagagtgggaccaggtggagacaattggatcatgggggcagttttccccatgctcttctcgtgataatgattgagtctcatgggatctgatgattctataagtgtctggcttttctcctacttgcactcactccatcctgccaccctgcgaggaaggtgcctgcttcttctttgccttccgccgtgagtgtgagtctcctgaggcctccccagcaatgtggaactgatacgtcatggaacagagggcaacctgcctcctggaaatgtggagtgtctagggagtcacagctgagatcttccttggattaaaggctgcgggtgtcacaaacaggatgctgtaacaacaccataaactttcaaacaactctatttccta

SEQ ID NO: 2420 - DNA, 468 bp, Homo sapiens
ccgtgcggtgcggccagtgaggctccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagt

SEQ ID NO: 2421 - DNA, 586 bp, Homo sapiens
caaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaatgtgcatcaatcatgccttgccc

SEQ ID NO: 2422 - DNA, 462 bp, Homo sapiens
ggcattccatgtgagtcggctcatgcagtatgtccggctcctttcactgagcataaggtcttcagcactcatccaggttgcagcctgaatttcattccctcttctggctgaatcgtattccattgtgtatcttggacatatcctattctgctcacccagccgttggtgggcgtttggagtgttttcgcctttcagctgctttaagagggttgcagtgaacatttgtacaagttttggacccaatgcctgttttcaattctcttgtgtagagagcactttttagcagaaaaagaatagatttgtggcctccctttgtgtgcggtcagtgccttgagaagagtgaactgtgctgccacctccggagccgtggagagcgcggggcttgggtagcagctaggacgatacaagttgggacaaggccaggtgcaatggctcacgcctgtaattccaacactttgggag

SEQ ID NO: 2423 - DNA, 280 bp, Homo sapiens
ggcgccaccggctacgtgcccagcgctcgcgtctgctccagtcgctctggcggtgcggggcgctggcgacgggacagggtttttgctgcccggggcctagtctacctcggcacgcctttctctgaaggagacacgcacttgcacgacgtgggcctctgtgcagctctactttgtccttaactcctctgactcaacgttatcgcagtttgactctggagccactcaggtttttcctaagctcaactctagccagctaggttcctggtgctttgggggctgg

SEQ ID NO: 2424 - DNA, 362 bp, Homo sapiens
gcacttttgatttacttctgacttcacgagtcactttctgccaaagaaatctctccttttgcttctagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactc

SEQ ID NO: 2425 - DNA, 449 bp, Homo sapiens
gagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatatta

SEQ ID NO: 2426 - DNA, 450 bp, Homo sapiens
ggaccacgttattagtgccattccagcttcaggtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgctccctgctgaggctgcccctctggctcatgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtg

SEQ ID NO: 2427 - DNA, 497 bp, Homo sapiens
ataacttaaaataacaagtttggaaggaataaaaagtctgggagactatttgttttgtctaaattctgcttttactctggtcttttaacagttggcttttgataatgtattactgccttagtgtgttcctgtgtattgaaggaatacattgtctgacagaattgtggttgaaaatattacaagttctaaataataagagtaataaatatcatatcttgtttgctttgttgtcatagtcgcctgatctcatgcttccctgaattcggctggtgtcttgattacgatggaatcactaagcagagagttttgccatgtgtgatttattcgtttgtgcatagccacagcagagcatccatgcagcccgcagtggctctgtgttccagtgtggcaagtcaccaagacttgctaccttaaggccaggcgcagtggctcacgcctgtaatcccagcactttgggagactgaggcgggcagatcacttgaggtcaggagttcaag

SEQ ID NO: 2428 - DNA, 430 bp, Homo sapiens
agagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactaggctcatactcaattgatggttatta

SEQ ID NO: 2429 - DNA, 511 bp, Homo sapiens
ctattttatgccaggcattgggcaaggacccattggatatacagagatgactgacacagcatttagtttttcagaatctcatcggatagaggagacaatccaggctgagagcactatataaacaaaaggctggagtcctgaaaatgctttatgtgtttgcaggggatatagtttatgaaggaggggattaggcttaaaaagagctagacagtgaaaggtgaaagtagggaacagtggaaggtgatatggcctttaaactttgctgcttacaggtctttcaggttacagtttgaacttgatcctggaagcagcagagaaatcaatcactggctactcttaaaacagctgagtgacacaatcaaatgtgtacttcagaaattttccatgtggcaatgtggaggatgggctggattgccttgttattgggagacaaattagaaggctactgcaatagtcctagcaagagatgatgacaggctgggcacggtggctgacacctgtaatcccaaca

SEQ ID NO: 2430 - DNA, 652 bp, Homo sapiens
acagtaagggagtgtatggttaacagaaaaaaattatacaattttgacaatattatttttcgtatcaggttgctgtttaattttggaggggtggggaaatagttctggtgccttaacgcatggctggaatttatagaggttacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggcc

SEQ ID NO: 2431 - DNA, 129 bp, Homo sapiens
atttcagtccacatatgaatcatcagtgtattttccataaagtgattcgggcatatttgtgtgaaaacctcagttctgtcacttcttacctctataaacttggacgataatgtgccttctctgagactc

SEQ ID NO: 2432 - DNA, 469 bp, Homo sapiens
atagactacctccttcctggaaaagtctcagcttcatattctgttgaatatatgcagaattcttagtgtgaaaggtgatgtaccacttcagatcagttttcactggagagacttgtaattggtagctgtagctcgtatccgtggcgtagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggggtgggggggagcgctgaatttgtagcatttgctgcaaatataaattataaataaaattctaatataaattagaattttatatcaaattctttgatataaattagttactcctcctgtggctgatttcaagctaccaccttagagt

SEQ ID NO: 2433 - DNA, 171 bp, Homo sapiens
ttgaggctgcagtgaactatgattttaccactgcactccagcttgggcaacagggtgagaccctgtctcaaaaaaaaaaaaaaagtttttttaaaataaccgggataattgtttattttgaaaagggaccgggaacttaaagggctttaaaaagggtgggtttttttttaa

SEQ ID NO: 2434 - DNA, 444 bp, Homo sapiens
gcttccttaactggagctacacagaaggagttgagtgatggtagatatcaggccctggtctgcggcttggaagtttcctgtgaataagaaaaacatcatcgcttcttgagtcacaaggatgataggatgagaaaaagaaaggacaaaggcaccagaggaggtaagaacatatgagaggcaggctgagaccaattttctaccaggccagctaattcatcacaatgacaagctatgggtcatatgctttcaggaaccagacactggaacatgtcgtctgatgtacatcacaccaagaaataaaaaaagaattggaaagccaatgtccaattatttactaaaacaggatccactggagagaaatgcaaaggcaggtaaaaaggcaatctcttaacatgaaaactcacaactgtaaaatgagaacctaaactatacagcgacaaactc

SEQ ID NO: 2435 - DNA, 478 bp, Homo sapiens
agttcaatggggatggagaaaacagagcattcctctgagagcagagatcttgtcattattgcaattaatgcccaaacaggttaaatgtggaagaaagtatggaggaaataaccccagccttcctcataccactggatttccacatcaccttttaacttatgcttgagctcccttttgagaaaaaatatttaaaaacaaattggctatgtaacaaatttgtgtgtgtgtgtgtatatatatatgtatatgcttatatatatatatatgtatatgcttgagaaagtggtttttcaagatgtatgtgtacagtacacacatggacacgcttcagtcctctgacttcccatgtgctacctcatgtgtttctcttctcatgaagatttgcaatggatagttgtacaacctggggactgtcagtgactcattggtatcagcatatgctaaagaagctcttgaatccaatcttgaaacctgatct

SEQ ID NO: 2436 - DNA, 473 bp, Homo sapiens
agctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctgggataaagtttgtgttgagtacatctaggctgggtgtggtagctcacgcctgtaatctcagcactttgggaggccaaggcaggtggatcatctgaggtcaggagttcgagaccagcctggacaacatggtgaaaccctgtctctgc

SEQ ID NO: 2437 - DNA, 425 bp, Homo sapiens
gggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgaaggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgc

SEQ ID NO: 2438 - DNA, 420 bp, Homo sapiens
gacaccacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacaactacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccggg

SEQ ID NO: 2439 - DNA, 434 bp, Homo sapiens
ggacccgccttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacct

SEQ ID NO: 2440 - DNA, 506 bp, Homo sapiens
atctgatggagtaattgtttttgcaagcatctgagagcattttatgattaaacatattaacttcacctattcaaatatagttggaaaaactatagaagaacacaatggtttatctagatcataaagggtacctctctgtccagaaattaaaaagcttgccttttgtcactgctccaaataaattggaagctctggctgctcatgatgctctggtggagctctgtggagccatgaacactgccacctgcagtctgatgaagatagcaaatgatattcattttctgagttctggtccttggccaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactc

SEQ ID NO: 2441 - DNA, 100 bp, Homo sapiens
tacggctgcgagaagacgacagaagggtacggctgcgagaagacgacagaagggtacggctgcgagaatacgacagaagggtacggctgcgagaagacga

SEQ ID NO: 2442 - DNA, 182 bp, Homo sapiens
ggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtac

SEQ ID NO: 2443 - DNA, 255 bp, Homo sapiens
ggaagcacatatctttccactcagaatttcaaggggaaaatgttgatagtttttagcaaaggtgtgtccaaatctgaaagttggggtttgctttcattatttctttcttttctgtatttcttcacctatcttgatcaagaaaataaacagcttatatttttctaaatttcacacgatgtaataaaatttagaagtaaaagactaggaattctgacatggtctgtacgatggtctatacagggcattaaacaatgc

SEQ ID NO: 2444 - DNA, 261 bp, Homo sapiens
cctctgtttgccgctctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgtcttgcattacacatagtaaactttctttaaaaaaaaaaaaaaaaaatttgggaaact

SEQ ID NO: 2445 - DNA, 438 bp, Homo sapiens
ggttttcccgaacgcccgcagcagggtcagaagggaggtggccggtctccgtcgtgacctctgacggtttctgagcgttggcctttggcacgcgctacccccttttgctttggttctgccatgccgatgtaccaggaagagtctaacctgtctcggcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttc

SEQ ID NO: 2446 - DNA, 417 bp, Homo sapiens
atccaaattcaaaaaaggcatgctgaaaaatttaacagctgaaaaacactttctccttgctgggaaaacttaaaccttgctaggctttatgcaacttaaaaaaaaaaaatcacttctgtgctgaaaactagcatgaaaaatctcaccatgaaaggttgggggattttttttcttcataaaactaaccccaattgttggttttaaaagtgatgccacaatatacatatgctttgttaggaacaaatataatctaatttcaagggcatcttcaacaaaaattagggggaaaaaataaaggctacttaaccagtgatccagtgtctgaaagcaaaggttgaaaacatcattgtaccatcaaggtctaaaaatgctgctaaccctgaccgggttgttactgtttgaaaagcctatgggtat

SEQ ID NO: 2447 - DNA, 517 bp, Homo sapiens
agccactcaaaaatgctgggttcctgtccttggtcttaatgaaaaaacaatgttgttataaagaaggaggggaaaattacctgatttccgaatgtagaaataaacaagcaaaatataagccaggctatttatatttgcttaacaagaaagaacttctttcttgctttgcgatgcatttgaaataccgtttgtggccagataaattacgattgcttttcaaggttacatggtgtttctcactcaccatgctccaccttctggccaaaaggagtactctctgttcctgttttcccaactagctcactaaatatggggcaagattctgaccacccacctaattcatattgacttctaactttgaggtcatcgtgagagtctggggggcagcaattacttccgtagttctatcttaataacagatgacacagtttgcctccatccatcctaaagttaattgacccaatcacatgctactttcccagtattttcacttaatcatcagcaactatttcagtga

SEQ ID NO: 2448 - DNA, 454 bp, Homo sapiens
gcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttt

SEQ ID NO: 2449 - DNA, 464 bp, Homo sapiens
tgggattacagctttgggatgaccgcttacaaagttctgtttggttagtattggcatagtttttctatatagccataaatgcgtatatatacccatagggctagatctgtatcttagtgtagcgatgtatagggggacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaac

SEQ ID NO: 2450 - DNA, 509 bp, Homo sapiens
gaaaggaatcacaccattattccttagaagtaattacatgtgttctaacacatttgagacagggttggactcccatttctcatccgagaagttacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaa

SEQ ID NO: 2451 - DNA, 549 bp, Homo sapiens
gagaccagcctgaccaacatggtatcgctcctaaaatacaaaaattagctgggcctggtggcgcatgcctgtaatcccagctactcaggagacttgaggcaggagaatcgcttgaacctgggaggtagaggttgctgtgagccgagatcgcaccaccgcactctagcctgggtgacagagcgagactccatctcaaaaagaaagaaagaaagaaaatgccagacatttattgaggggctggaatgatatagtgaagtgttctgagtcagtcgggctctgattgataaagagcttggcatgtttgaaggacagcaaggaagccagaatagctggagcgtagcagcggggagacaaatgccacaaggttagttggagaaaggcattgggaaaggtttgtcttttaagtgctctgagaagcaattgaaggtttgaaatagaatagtgacttgcttgatcacatttgtacttttgaaaagtttctctggctgctgtggggaaaggcttcagtagatgcagggtcggagaagataaccagcagtagactcttgt

SEQ ID NO: 2452 - DNA, 163 bp, Homo sapiens
acgacagaagggtactgctgcgagaagaccacagaagggtactcctgcgataagacgacagaagggtactgctgcgagaagacgacataagggtacggctgctagaggacgacagaagggtactgctgcgagaagactacataagggtactgctgcgagaaga

SEQ ID NO: 2453 - DNA, 280 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcg

SEQ ID NO: 2454 - DNA, 394 bp, Homo sapiens
gagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccaccccccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtgga

SEQ ID NO: 2455 - DNA, 75 bp, Homo sapiens
actatgccctcccttgaaaaggtggcttgcctctctttctgtaagcaaagtcatgtcataaacagtattaaacaa

SEQ ID NO: 2456 - DNA, 502 bp, Homo sapiens
agaaaaaggtgcacaagaaagagcataggattgtgccagcattgatgttatcttctggttatatgagagtgttttgccaagaatcggtcaaatgttttacattagggaaaaagcattattgttactggcatagggagggccccagttaaaatagcagtccaattcagagaccttcgtatttgtcgttaagatcaaaaggactcttggaataatggactatgctacaggattattttaagttcagatagataaattagcttcttcccaaattctcattctgcttttcctgtggtactgtatagtatcatgaagttatatctttaaactcttagtttgtactatgtggtgtcttatgaaaaccttgatttgtttatacttagtgaatgaaacacttgggtttaaagttctttaactgatgtcacttcttaagctagaaagctgttgaaagaacttagtgttccacccttagaccaaggttcatgtcaccatatttaacagcagc

SEQ ID NO: 2457 - DNA, 416 bp, Homo sapiens
agaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagatgggtacggctgcgagaagacgacagaagggcaccctctaaatcaccacgat

SEQ ID NO: 2458 - DNA, 369 bp, Homo sapiens
ggaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttttaacagggtctcattttgccccccaggcagaattgcaggggctaaattttgggctcactgaaccctaaacctcccaggttaaagcaattttcctgcctaaccccctaaagtacctggaactacaagcccacaccaccaccccggacaaatttttggaattttttggaaaaggcggggtt

SEQ ID NO: 2459 - DNA, 466 bp, Homo sapiens
gaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccccctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacggctggaagggactactgatgttctgtgatacatcaggtttcagcacacaacttacatttctttgcctccaaattg

SEQ ID NO: 2460 - DNA, 411 bp, Homo sapiens
gatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagag

SEQ ID NO: 2461 - DNA, 380 bp, Homo sapiens
gaagacgacagaaggatacggctgcgagaagacgacagaagggtacggctgcgagaggacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgaga

SEQ ID NO: 2462 - DNA, 565 bp, Homo sapiens
gagcgcagtctgctttggtgaatacacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatgctatattgaaaaactttttgagcgttatggtgaaaatggaagattatccttttttggtttggagaaacttttaacaaacttgggccttggagagagaaaagtagttgagattagtcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatc

SEQ ID NO: 2463 - DNA, 148 bp, Homo sapiens
aatagagattctgacgacacactgtgacatgattatgtctttgcatgtatggatatgatggggatgataaaatgaagaacttatggcttatttgcacccccactatcttctgttcattattgggactctttccctccgagtcaaaaac

SEQ ID NO: 2464 - DNA, 494 bp, Homo sapiens
ggaaccaccgtggcatatgccgtctgtcattgactgaaacgtcattatgcagggcatgactgtacttacaaaattagatggcacttcttaggaacattcctttgctatgagttgttttaaaacttaatgtacttaaattttttttattataaaaaatttccaacataaacaaagagggagaatgtatgtatattaagggtctcactctgttgcccaggctgtagtgccgtggtgcgatcatggctcactgcagcctcgacctcctggactcaagtgattgagggagaatattataatgaatgactttatattcctcacctgggttaggatgaaatgctaaggtcacagctaagcaaaagccactttaaaggaaaggaatgttgctgccacgagtggcgttcctgcagaaaggtcattaagtcagaattactactctgtgttctggagggaaaataccatgacactaagaatttagctgtgggtcagggaggcat

SEQ ID NO: 2465 - DNA, 197 bp, Homo sapiens
atgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagcct

SEQ ID NO: 2466 - DNA, 439 bp, Homo sapiens
atgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagctggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctg

SEQ ID NO: 2467 - DNA, 535 bp, Homo sapiens
cacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattgtaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaatttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagctatgttacttacgtttgatgctact

SEQ ID NO: 2468 - DNA, 596 bp, Homo sapiens
gggagaagccacttcccctctctggatctctgtttcactacctatgaggagattaaactagactgtctataagagtccttctctgagttgttctctgatcttagattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcagctacatgtttattgaatgatgaaacagctgaacacattcctgcacagaaaacacacattgtctaggtgacaaagagtaatgtggacacatcagggccaccttctgacctttgctagtttttttgttagtttgttttgtttttgtttctttgtattttttgtttgtttttgtgtctgtttttgagacagggtctcattctgtcctccggctggagtgcagcagtatgatcacggctcactgtagccttgacctcccagcctcaagcgatcctcccacctcagactcccaagtagctgggactacagtcatgcaccaccatgcccagctaaattttttt

SEQ ID NO: 2469 - DNA, 594 bp, Homo sapiens
atacacatatttaataaatagtacactgtactatggaaggatgagataaaatattatggaagcattagagagaaagagagaatttccaatctatgggtatcataggtggtttcttggaggaaagtggaactgaactaagcctcgaagttggtaaggaacagatggttggctatggtagggtggagaaaagcagagttgcagaattctcttatgttgtagtcccaaattaatagtaatgtactagattttcttctcctctcttgtgaatttccagcaacagcttgattttaacctccacagaaacacaaatgagagctgtgatggaaacaataattactagagtccagttttaactccaagtcaaaattttagtcacattcagccctgaataagaaataaggcaaagcatgcaacaggactttataactttttaattttaaggcattataaatataaatttttattttatcttatttttttagagatggggtcttgctctgttgcccaacaggagtgtagtggcaccttcttagcttactgcagccttgaactgttgggctcaagcgatccttctgcctcagcctgctgagtatg

SEQ ID NO: 2470 - DNA, 409 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggaaaagacaggatgattcatttacatctcttttccttcacagaatcatgagggaagta

SEQ ID NO: 2471 - DNA, 492 bp, Homo sapiens
ggctttccaactgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaggttctggctcgcagtctcaatattcctgggttgtatgtgcacgtgggaccttcctggtgcggtaa

SEQ ID NO: 2472 - DNA, 388 bp, Homo sapiens
atcctcagtgtctttgcccatactgaaattcatttcccacttttgtgcccattctcaagacctcaaaatgtcattccattaatatcacaggattaacttttttttttaacctggaagaattcaatgttacatgcagctatgggaatttaattacatattttgttttccagtgcaaaaatgactaagtcctttatccctcccctttgtttgatttttttccagtataaagttaaaatgcttacccttgtactgaggctgtatacagccacagcctctccccatccctccagccttatctgtcatcaccatcaacccctcccatgcacctaaacaaaatctaacttgtaattccttgaacatgtcaggcatacattattccttctgcctg

SEQ ID NO: 2473 - DNA, 222 bp, Homo sapiens
gagcgcctgcaggttccgggaggtcagctcccagccgaggacgtcggatgtcatcgtccttgctgctttgccaccccattcccgtcaataaagtggtttgaacccgaaaaaaaaaaaaaaaaaaaaaaaaaaaaaaaaacccccaaaaaaaaaaaaaaaaaaaaaaaagggggggggttttttttttaaaaccccccaaaaaaaaaaacttggggggggggg

SEQ ID NO: 2474 - DNA, 262 bp, Homo sapiens
aaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggc

SEQ ID NO: 2475 - DNA, 458 bp, Homo sapiens
gactctgatgggggctcagacttgataacacccgtggtgccccatccctataggagctggtgagattgcagcctgctgcctcccctccatcagccacagctattggacttcccacccagaatctttaggtaaatgaggtaagtcctgatttttaaaacttcttttgaatctggaatccaaacacctgagtggaaagagaagcctgctttaaactggacagatgaaactagaacagactcttggagacggctggcaggaagtgaagctcaccttacctgggcttacctcactgggtcaaatcagaattttattttggagggcaggttggctactttggatattatctgtgaatttcctgcatgtctggacttctaatctctgtgaatttaaaagccccctcgtttccctatgcctgggtggcaaaaccattcccctgggttgaattcttctggacaaat

SEQ ID NO: 2476 - DNA, 562 bp, Homo sapiens
  misc_feature 413: n = A,T,C or G
cagcacatgaagtacatttcagagcgtttgttttatcttgctagtttcgaatgatagattcctgtgaaagccaacaccatctcttctttgcccttgactgtgacctgcatgttaaaagatctagttttctggttatgctactgacttagaacattggaaaaccactttatacctgatttccctttaagcactatttatttgccatcttgatatttcagaatccttcaaatttatttagaggactttgaaaatatatcattgcacataaaatgcagttgattcaaaagagaacatttaaaacatacattttattaatcaaacttttattgttttaaaatgaagttttattttggccaccaccagtggctcacgcctgtaatcccagcactttgggaggccaaggcaggcagatncaccttaggtcgggagttcaagaccagcctgtccaacatggcaaaacctcgtctctactaaaaatacaaaaactagcctggcacagtggcatgcccctgtagtcccagatacttgggaaggctgagtcaggagaatcacttgaacctgg

SEQ ID NO: 2477 - DNA, 606 bp, Homo sapiens
gacagaagggggagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagca

SEQ ID NO: 2478 - DNA, 595 bp, Homo sapiens
acagaagggatagctcctatacaagtccaggatttgctattagactccttgaattatgtgcccagctctgagccaatggctgtgcttaggaggctcctgtctcatgcacccaccccagtactgggcatcagaaacaaccagtgatccctataatgaaccacgggttcacagacttaagtgtaatcctgcagcagggcctcaggaagacttgaaacccaaaatcagaaagccatggtttcttgtcttcctggtgtctgttttgtcccttccctctgtagaggagtcctgctatcactgcaggcaacggggctgccctgcagctcctgctgtttacatttcactcggtgtagccataggcagagacctcagggagaacctgattcggcttggattgagtcaggttccaccccagtccagtcagttgtggactgagaggtgatgaggctgggccctttaagacaaatctgggtgggtggagtctgtgcttaatgaagttgtgatgttagctgatggcccagaagggactggtaggtgcctctcactgtctggttgggaagcattctcttaagtccaagatgatgataaatagtattag

SEQ ID NO: 2479 - DNA, 302 bp, Homo sapiens
acgacagaagggtacggctgcgagaagacgacagaagggtacggctgcgagaagacgacagaagggtacggctgcgagaagacgacagaagggtacggctgcgaggagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgacaagacgac

SEQ ID NO: 2480 - DNA, 490 bp, Homo sapiens
gataccttgccctcctcccacctcagtggtagaaaacctttgatttatatcattgcaagttttcaaccccacactaaggacatactattttatttcttcttccataggaacaatgcacctttgtctgtgtcactggatggagattttccaaccctttaccacagtagcacaactctgcattagtgcaaaatcctgggccccaaaacaatccttgttcctctcctgatggagaagtatttttcttgcatccctcccccagaagcagtgatcctttgcctggtctcaggtgggatagggtagggtatgagaggtttcttaaccttctcggaaagctgatgtgttttgctgcttcttatctcccaaaaacagtagacttttgcgtgggttcatggacacagatgctttttttgccacagaaaacgaagggttttgattcttaagagagaagcaaatgttcatgtagtcaatttttttcttatttattttttgc

SEQ ID NO: 2481 - DNA, 617 bp, Homo sapiens
gaacaactgcgaggagatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgagactttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaagtgttcattccatctctcttcctttctcatgttttggctttggggctaggcatctatattggaaagcgactgagcacaccctctgccagcacctactgagggaa

SEQ ID NO: 2482 - DNA, 542 bp, Homo sapiens
acagaagggcaaagtggtcgactagtaatttaataacctgctagaagaaaaatgcattgcattagagaaagataaccaaacccagagtttgtataaatatcatgcacaatgttcaactgtaattcaaaaattaccagtgatggatacagaaaaatgtgacatgtaatttttttttaaagtccatggaaatagattcctcgatgattcagaagttgtagacaaggactttaaagcagaaattataaatatattcaggattttaaaaaaatatgttttcaggcccggtgcggtagttcacgcctataatccaccagatgtggtggcgtatgcttataatcccagctactcagaaggctgaggcatgagaatagatagcttgaacccaggaggtggaggttgcagtgagccgagattgctccactgcactctagcctgggcaacagagtgagaccctgtctctaaaaatatatgtatatatatagtcataatgagggaacagatgagaaaataagcagagaaatgaaaattttcaaaaataagta

SEQ ID NO: 2483 - DNA, 516 bp, Homo sapiens
acagaagggatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtc

SEQ ID NO: 2484 - DNA, 509 bp, Homo sapiens
cagaagggtacggctgcgagaagacgacagaagggtacggctgcgagaagacgacagaagggtacggctgcgagaagacgacagaagggtacggctgcgagaagacgacagaagggtacggctgcgagaagacgacagaagggcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccggaatct

SEQ ID NO: 2485 - DNA, 126 bp, Homo sapiens
gctcatggacgagatgggaaggcacagggagaagggataaccctacacccagaccccaggctggacatgctgactgtcctctcccctccagcctttggccttggcttttctagcctatttacctgc

SEQ ID NO: 2486 - DNA, 385 bp, Homo sapiens
tctggaatagaacaagaagatctatgtagcacaacaaaaaagttaattggaaactatgattaatggagaagtctatggggtcacgtggaaactgtttaccttgccacctctctgtagtcattaaaactcttgaaaatgaattttcttatcctaagagtgtaaaactgatgttgtggagcattttgcacatgccagacacagatgaattcaagacgcagtccctacactccgggtttctacagtttagctggacagagatgaacaaaattgcaatggagtgtgtaaggggccatagtgtgcaaggcccaacacctccctgagcgaaggacgtcagcactggttggctggatcctggccaagcttgctgtggggaagtggtcgatgt

SEQ ID NO: 2487 - DNA, 500 bp, Homo sapiens
tacggctgcgagaagacgacagaaggggatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaaggcaggcagagtgcaccgtatcgagggagaacttcgattctgcgggatggcatcactgcagggaaggctgctctccgaatacacaacgtcacagcctctgacagtggaaagtactt

SEQ ID NO: 2488 - DNA, 578 bp, Homo sapiens
gtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttaaatttcaccgtgtcttaatgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaact

SEQ ID NO: 2489 - DNA, 94 bp, Homo sapiens
accattaaaaacttcaactcacacgcactacctagaaaaacccaaacatataactgaactcctcacacgcgattggaccaatctatgaccctat

SEQ ID NO: 2490 - DNA, 396 bp, Homo sapiens
gacagaagggtacggctgcgtgaagacgacagaagggtacggctgcgagaagaccacagaagggtacggctgcgagaagacgacaccgaggtacggctgcgagaagacgacagaagggtacggctgcgagaagacgacagaagggtacggctgccagaagacgacagaagggataggtttggtcctagcctttctattagctctgagtaagattactacatcgcaagcatccccgttccggtgagttcacgctcgaaatcaccacgatcaagagggacaagcatcaagcacgcagcaatgcagctcaaaacgcttagcctagccacacccccacgggaaacagcagtgattaacctttagcaataaacgaaagtttaactaagctatactaacccc

SEQ ID NO: 2491 - DNA, 400 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggcttcctttctgggctcggacctaggtcgcggcgacatggccaaacgtaccaagaaagtcgggatcgtcggtaaatacgggacccgctatggggcctccctccggaaaatggtgaagaaaattgaaatca

SEQ ID NO: 2492 - DNA, 236 bp, Homo sapiens
gaagggtacggctgcgagaagacgacagaagggtacggctgcgagaagacgacagaagggtacggctgcgaagacgacagaagggtacggctgcgagaagacgacagaagggtacggctgcgagaagacgacagaagggtacggctgcgagaagacgacagaagggtacggctgcgagaagacgacaggagggcaaccacctccctccagacagggatgtactagatggcgagcag

SEQ ID NO: 2493 - DNA, 519 bp, Homo sapiens
gaccattcttagtggcactggggaaatcttggcacccagaagaattcaactgcgctcactgcaaaaatacaatggcctacgttggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagccagtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttc

SEQ ID NO: 2494 - DNA, 409 bp, Homo sapiens
taccagaaagctgtaggtttaacttaagatgacttagacaatgaaaacgctactgggaaagagatactaaaatgttcacagttttgactgacagaaagactcatgagaattgtataactttgaaataagtcagataaatcctttctaggatgatgggacagagaaattgtaaaggtttaggattacctgtttactgcttcagagaaattaaaaaatacacttttacgaaggccagtaagaactattttctggaacaaacggaaaaagctggataatgctactgactgagtgaaggggataagccacccagtacccaggcctgagtttcacctaacaaggagacaggcctcgagcattgttaagagccataagattctattttccagtgagagagtaccacttacgtgat

SEQ ID NO: 2495 - DNA, 336 bp, Homo sapiens
gcaatctttgtattgtttttctactaagtaaaaaggtcagacttggatatggtacatttaaagaggatgctgattagtcacaaaattttagccatctaagagttcattcagtttctcccttaggtgtttcccttttattaatttcctttgctttctggccccagaagtgtaactggtaaccaattttaggtgtggtttctaatataagtttactcatggagacaatgaaaaaaaaaaaaaaaaccccaaaaaaaaaatattaaattggttttaaaaaacccagggtttttttaaaagggggcctgggttttttaaaaaaacttttaatttcaaaaa

SEQ ID NO: 2496 - DNA, 501 bp, Homo sapiens
gattctgctttccaaccgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggaacagaagttctggctcgcagtctcaatattcctgggttgtatgtgcacgtgggaccttcctggtgcggtaaaaca

SEQ ID NO: 2497 - DNA, 584 bp, Homo sapiens
acagaggggtggtgttgtttgtgtggatggtgacaagtcctactgctggacagagtgagtaggtcctctctgcagtttcttagctacctcatatggcttagggtggatcctgctgtgggatttataccagcgtgccaatgctaagaggggcctaattctccctctggggagtggccagagaggataacatgactgagaagtgtgcgagggaccttcagagggggaaagtgaggaaacagttcaacctcccagggcaggcaaagcaagacatccctggtttaaggggttgagtcttctggggcaggcaaggcaagacatccctggtttgaggggttgagccttccagtaatttcaggagattgaacctgacaagtacccaacatgggaaatgtttctagtaaaacaaggacagggagtaaagatgactcagggaaaggtgaaggtgatcagatttcttctagtagtccttcagggtgtatgttaatatattagaaggataatgaaaggaccaaaatcaagaaaaagcagctgctgtcccagacccttctcctatccctgttgtcctcctctttataaccctgcct

SEQ ID NO: 2498 - DNA, 294 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggttgcgagaagacgacagaatggtactgttgctagaagacgacagaagggtacggctgcgagaatacgacagaagggtacagctgcgagaagacgacagaagggtacggctgctagaagacgacagaagggtacggctgcgagaagactacagaa

SEQ ID NO: 2499 - DNA, 592 bp, Homo sapiens
gacagaagggtggtgttgtttgtgtggatggtgacaagtcctactgctggacagagtgagtaggtcctctctgcagtttcttagctacctcatatggcttagggtggatcctgctgtgggatttataccagcgtgccaatgctaagaggggcctaattctccctctggggagtggccagagaggataacatgactgagaagtgtgcgagggaccttcagagggggaaagtgaggaaacagttcaacctcccagggcaggcaaagcaagacatccctggtttaaggggttgagtcttctggggcaggcaaggcaagacatccctggtttgaggggttgagccttccagtaatttcaggagattgaacctgacaagtacccaacatgggaaatgtttctagtaaaacaaggacagggagtaaagatgactcagggaaaggtgaaggtgatcagatttcttctagtagtccttcagggtgtatgttaatatattagaaggataatgaaaggaccaaaatcaagaaaaagcagctgctgtcccagacccttctcctatccctgttgtcctcctctttataaccctgcctcttggga

SEQ ID NO: 2500 - DNA, 591 bp, Homo sapiens
aagggtgagccctttacttgggatgtacaggctttgagcagtgcagggctgctgagtcaaccttttattgtacaggggatgagggaaagggagaggatgaggaagcccccctgggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgat

SEQ ID NO: 2501 - DNA, 541 bp, Homo sapiens
aagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtcccaataaataaataaataaataaataaataaataaataaataaaaaaaaacaaagttgattaagaaaggaagtataggccaggcacagtggctcacacctgtaatccttgcattttggaaggctgaggcaggaggatcacttt

SEQ ID NO: 2502 - DNA, 306 bp, Homo sapiens
gagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaggatggctggcattggcatcggggaagcctcttc

SEQ ID NO: 2503 - DNA, 387 bp, Homo sapiens
atttatcgggatgacaaatccatagaatatattcttttatgttaaattattatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaaaaaaac

SEQ ID NO: 2504 - DNA, 541 bp, Homo sapiens
gacttcctgcgaggcccctgcagcagcagcggcgtggtcagagcgagcttcggagaagcagtggtgggttccacgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgat

SEQ ID NO: 2505 - DNA, 572 bp, Homo sapiens
gatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgac

SEQ ID NO: 2506 - DNA, 114 bp, Homo sapiens; identical to SEQ ID NO: 675
  misc_feature 70: n = A,T,C or G

SEQ ID NO: 2507 - DNA, 430 bp, Homo sapiens
gggactcgccacctcctcttgcacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgaacaaggtccctctgcagcagaacttgcaggacaaccaattccaggggaagtggtatgtggtacgcctggcagggaatgcaattctcagagaagacaaagacccgcaaaagatgtatgccaccatctatgagctgaaagaagacaagagctacaatgtcacctccgtcctgtttaggaaaaagaagtgtgactactggatcacgacttttgttccaggttgccagcccggcgagttcacgctgggcaacattaag

SEQ ID NO: 2508 - DNA, 527 bp, Homo sapiens
ctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggac

SEQ ID NO: 2509 - DNA, 262 bp, Homo sapiens
  misc_feature 186, 188: n = A,T,C or G
ccggcctcgtggaccagcctgggctctcgctggaggaagtggcttgcaaggaggcttgggaggagtgtggctaccacttggccccctctgatctgcgccgggtcgccacatactggtctggagtgggactgactggctccagacagaccatgttctacacagaggtgacagatgcccagcgtacgntnccaggtgggggcctggtggaggagggtgagctcattgaggtggtgcacctgcccctggaaggcgcccaggcctt

SEQ ID NO: 2510 - DNA, 201 bp, Homo sapiens
gccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaa

SEQ ID NO: 2511 - DNA, 621 bp, Homo sapiens; identical to SEQ ID NO: 1210

SEQ ID NO: 2512 - DNA, 548 bp, Homo sapiens
gacagcatggacatgagggtccccgctcagctcctggggctcctgctactctggctccgaggtgccagatgtgacatccagatgacccagtctccatcctccctgtctgcatctgttggagacagagtcaccatcgcttgccgggcaagtcagagcattggcatctatttaaattggtatcaacaaaaaccagggaaagcccctaaactcctgatctatgattcatccagattgcaaagtggggtcccatcaaggttcagtggcagtggaggtgggacacacttcactctcaccatcagcagtctgcaacctgaagatttagcaacttactactgtcaacaagggtacagtacacctggcaccttcggccaagggacacgactggaaattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactc

SEQ ID NO: 2513 - DNA, 430 bp, Homo sapiens
tatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgac

SEQ ID NO: 2514 - DNA, 493 bp, Homo sapiens
ctcactatttggaatttggccctcgaggccaagaattcggcacgaggcggcacgaggtgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacactttttttttttttttaaaaggaaaaaatgt

SEQ ID NO: 2515 - DNA, 472 bp, Homo sapiens
cggcacgaggtgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttatttttttttaaaggtagagatgtgtgtgtgtgtaggtattaaagatgtg

SEQ ID NO: 2516 - DNA, 271 bp, Homo sapiens
gtttttcttttttttatacacaacatttatttcaaactattgggagggatgagagtggcttaaaaacttccatccctacttttcaagagtgcagttgattctgggggggaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgct

SEQ ID NO: 2517 - DNA, 343 bp, Homo sapiens
gtttttcttttttttatacacaacatttatttcaaactattgggagggatgagagtggcttaaaaacttccatccctacttttcacgagtgcagctgattctgaatctgaaagcccgcctctgtcctaaaatacaaacacgcacagacattagacctggatactatatgatacagagggatgtaactattgaattggatacacggatcacaatggaaagaaactcacgatgaaattgaacctggcttttgtatatttatcaaacttgtgctgagaatagcgcctgattatacgacttttaagcaaagctgggtgtaattaggtgaaaacagcccacgtcctcc

SEQ ID NO: 2518 - DNA, 345 bp, Homo sapiens
agtggcgagcaggttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacg

SEQ ID NO: 2519 - DNA, 401 bp, Homo sapiens
ttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcggctctttggcctgaaagttgggaatggttgggggagagaagggcagcagcttattggtggtcttttcaccattggcagaaacagtgagagct

SEQ ID NO: 2520 - DNA, 442 bp, Homo sapiens; identical to SEQ ID NO: 1172

SEQ ID NO: 2521 - DNA, 256 bp, Homo sapiens
  misc_feature 96: n = A,T,C or G
gaatatgtagatttgcttcttaatcctgagcgctacactggttacaagggaccagatgcttggaaaatatggaatgtcatctacgaagaaaactgntttaagccacagaccattaaaagaccttaaatcctttggcttctggtcaagggacaagtgaagagaacactttttacagttggctagaaggtctctgtgtagaaaaaagagcttctacagacttatatctggcctacatgcaagccattaatgtgcattt

SEQ ID NO: 2522 - DNA, 405 bp, Homo sapiens
attctgtgatttatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagct

SEQ ID NO: 2523 - DNA, 447 bp, Homo sapiens
tgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgcctt

SEQ ID NO: 2524 - DNA, 294 bp, Homo sapiens
tgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggg

SEQ ID NO: 2525 - DNA, 562 bp, Homo sapiens
aggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggc

SEQ ID NO: 2526 - DNA, 721 bp, Homo sapiens
  misc_feature 626, 685, 696: n = A,T,C or G
ggcacgagatgaggagcaggttggactggccatccgaagcaagattgcagatggcagtgtgaagagagaagacatattctacacttcaaagctttggagcaattcccatcgaccagagttggtcccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccaccctgattgccctgcgctaccagcttgcancgtggggttgtggtcctggccaagagcttcaatgagcacgcatcagacagaacgtgcangtgtttgaatncagttgacttcagaaggagatgaaa

SEQ ID NO: 2527 - DNA, 496 bp, Homo sapiens
agatgataaccagaagtctgcatttgaagttcacaaaagtaatcaagctcaaacagttagtgagaggcagaagaacagacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaaattaatgttattgccaagaacactggtaataaactgaagctaagtcagaaaaaatggttgtttgctagatcccaatggagaaaagtgtgtaactgctcctcgtcaggtctctgctcttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaat

SEQ ID NO: 2528 - DNA, 549 bp, Homo sapiens
ctgcatttgaagttcacaaaagtaatcaagctcaaacagttagtgagaggcagaagagcagacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaaattaatgttattgccaagaacactggtaataaactgaagctaagtcagaaaaaatggttgtttgctagatcccaatggagaaaagtgtgtaactgctcctcgtcaggtctctgctcttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagc

SEQ ID NO: 2529 - DNA, 55 bp, Homo sapiens
gtgtctgccttcacaaatgtcattgtctactcctagaagaaccaaatacctcaat

SEQ ID NO: 2530 - DNA, 498 bp, Homo sapiens; identical to SEQ ID NO: 1313

SEQ ID NO: 2531 - DNA, 325 bp, Homo sapiens
gtcgctgcctctgggggcgctgtacaccgcggccgtcgcggctttagtgctgtacaagtgtgtgggggggggagatgaaactgcggttctccaccaggaggcaagcaagcagcagccactgcagtcagagcaacagctggcccagttgacacaacagctggcccagacagagcagcacctgaacaacctgatggcccagctggaccccctttttgagccgtgtgactactctggctggagcccagcaggagcttctgaacatgaagctatggaccatccacgagctgctgcaagatagcaagccggacaaggatatggaggcttc

SEQ ID NO: 2532 - DNA, 166 bp, Homo sapiens
gaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttc

SEQ ID NO: 2533 - DNA, 501 bp, Homo sapiens
tttttttttttttttttttttttttcgcagctgaattacatttactgtacaaagaacggttcggagagaaccaggaatggcggagtgtctaacagcagcgcgggtagtgttgatgccgtgaatgcaggaccatccaggtcctcaaagtctgcgaggtttgttcataatcccaaacaagggccctgctggcagcaacaggacaggtggggccaggacagggaagctggagcaggaggccagtgtctttgggggctgtggcagggccgcctgcctggggttcccttactcatctggtagttcatgcaggccacggccctcatctcccaggaacgggccatggggcgagtccactggtgcccagtaacaccctccgtgggaccaccttgggaagcatgtgccgcggagtccaccacggggggtcctgggtcccgggagggctccttctgcgtgctggccatgtcgtgccgcacggcctgaggacaggaggtagaggtgagcacc

SEQ ID NO: 2534 - DNA, 149 bp, Homo sapiens
cgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaa

SEQ ID NO: 2535 - DNA, 475 bp, Homo sapiens
agcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaattt

SEQ ID NO: 2536 - DNA, 570 bp, Homo sapiens; identical to SEQ ID NO: 1576

SEQ ID NO: 2537 - DNA, 645 bp, Homo sapiens
tccgagcgtcgggagcctgtggaagagaagagcgcgcgggcgacagttaaacaggcccgaggcagagaaaccgccctagcagctctcgcgcgcccggtgcaggcggcggttgctgcggaggtccgtgcacagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaatggcgccgatccaaatattacggatgtctttggaaggactgctctgcactacgctgtgtataatg

SEQ ID NO: 2538 - DNA, 572 bp, Homo sapiens
ctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttctggtcattatttcgtttgcatgatgtattgcttcttcacgttttgtttttattgagcacggagtag

SEQ ID NO: 2539 - DNA, 701 bp, Homo sapiens
  misc_feature 34, 41, 43, 52, 58, 72, 180, 204, 205, 211, 214, 228, 243,253, 269, 271, 295, 315, 343, 429, 439, 457, 483, 517, 529,546, 554, 555, 557, 560, 561, 565, 627, 632, 637, 644, 655,659, 662, 672, 680, 689, 690, 698: n = A,T,C or G
ggcacgaggctaactgtgtaacatttatgaaatntgctctntntggcggcgnaggggncggaatgagaaggnaattcagtagagtgtaacttagagaatattgcaagggacacattgaatcctgcccgtcagggcaccttttcctcagagcaatccggccacacgaatagaaggctgcgngaatcacatcagatgtaaaatcannccttcnggngactcttttaattntcatcctttgcaggnagggcaaatncaacttcaaatatggngnaggttttgctagattccatatttntttcttggatttttgctaantatttttagcaaaaaatttttgctcagnggcaccctccctagtgtccatgggttagggccatgctggggaaaacgggccggtatttacacacgcgcaaaacacccagagacggnacaaggaggntgaactcatgtttcagtncgcgaacattgactccttacgaaagncacttcattctaactagatgcgcccacttctggncattattacgantgcatgaaggattgctncttcacgnntnggnnttantgagcacgggagtagaaattccagggctggcttgacatcttccctgcatgctccctcccagnggacngtccntcccttncacatgagganctgncgnccatggtggntttctccnttgggcctnntgggactngga

SEQ ID NO: 2540 - DNA, 300 bp, Homo sapiens
gctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatt

SEQ ID NO: 2541 - DNA, 374 bp, Homo sapiens; identical to SEQ ID NO: 803

SEQ ID NO: 2542 - DNA, 290 bp, Homo sapiens
gaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaa

SEQ ID NO: 2543 - DNA, 405 bp, Homo sapiens
gccctttcgagcggccgcccgggcaggtacctgggattacaggcacccaccaccacgcctggctaatttttttttgtatctttagtagggttttgccatgttggccaggctggtctttaactcctacctcgtgatccacccgcctcggccccccaaagtgctaggaccacaggcgtgagccaccacgcccagccccctgtctctttttttaaaacacaatttaaaagcagaaagaaaaaatctgtgctgtttagactcagattcttaattagctagtatttcttaattcaatcaataaattattaagaccttttcactgctccctttttaaagtcttctttggagtgatttaagtgcttcttattaccaagctctcaaagagaagataaaattaaaatctgatgg

SEQ ID NO: 2544 - DNA, 736 bp, Homo sapiens
  misc_feature 2, 3, 4, 5, 6, 7, 8, 9, 14, 15, 16, 17, 18, 19, 20, 21, 22,23, 24, 25, 26, 27, 28, 29, 30, 31, 32, 33, 34, 35, 36,37, 38, 39, 40, 41, 42, 43, 44, 45, 46, 47, 48, 49, 50,51, 52, 53, 54, 55, 56, 57, 58, 59, 60, 61, 62, 63, 64,65: n = A,T,C or G
  misc_feature 66, 67, 68, 69, 70, 71, 72, 73, 74, 75, 76, 77, 78, 79, 80,81, 82, 83, 84, 85, 86, 87, 88, 89, 90, 91, 92, 93, 94,95, 96, 97, 98, 99, 100, 101, 102, 103, 104, 105, 106, 107,108, 109, 110, 111, 112, 113, 114, 115, 116, 117, 118: n = A,T,C or G
  misc_feature 119, 626, 627, 628, 629, 630, 631, 632, 633, 634, 635, 636,637, 638, 639, 640, 641, 642, 643, 644, 645, 646, 647, 648,649, 650, 651, 652, 653, 654, 655, 656, 657, 658, 659, 660,661, 662, 663, 664, 665, 666, 667, 668, 669, 670, 671: n = A,T,C or G
  misc_feature 672, 673, 674, 675, 676, 677, 678, 679, 680, 681, 682, 683,684, 685, 686, 687, 688, 689, 690, 691, 692, 693, 694, 695,696, 697, 698, 699, 700, 701, 702, 703, 704, 705, 706, 707,708, 709, 710, 711, 712, 713, 714, 729, 736: n = A,T,C or G
gnnnnnnnnagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgggattacaggcacccaccaccacgcctggctaatttttttttgtatctttagtagggttttgccatgttggccaggctggtctttaactcctacctcgtgatccacccgcctcggccccccaaagtgctaggaccacaggcgtgagccaccacgcccagccccctgtctctttttttaaaacacaatttaaaagcagaaagaaaaaatctgtgctgtttagactcagattcttaattagctagtatttcttaattcaatcaataaattattaagaccttttcactgctccctttttaaagtcttctttggagtgatttaagtgcttcttattaccaagctctcaaagagaagataaaattaaaatctgatgggtaaccatttaaataagacaactggggtaacccatttctccaggacccctctctgcaacagagagctattctctttctttggcctagtaaacctctgctcttaacctttaaaaaaaaaaaaaaagtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagtggttcctgngtgaaan

SEQ ID NO: 2545 - DNA, 725 bp, Homo sapiens
  misc_feature 2, 3, 4, 5, 6, 7, 8, 9, 10, 12, 13, 15, 16, 17, 18, 19, 20,21, 22, 23, 24, 25, 26, 27, 28, 29, 30, 31, 32, 33, 34,35, 36, 37, 38, 39, 40, 41, 42, 43, 44, 45, 46, 47, 48,49, 50, 51, 52, 53, 54, 55, 56, 57, 58, 59, 60, 61, 62,63: n = A,T,C or G
  misc_feature 64, 65, 66, 67, 68, 69, 70, 71, 72, 73, 74, 75, 76, 77, 78,79, 80, 81, 82, 83, 84, 85, 86, 87, 88, 89, 90, 91, 92,93, 94, 95, 96, 97, 98, 605, 606, 607, 608, 609, 610, 611,612, 613, 614, 615, 616, 617, 618, 619, 620, 621, 622, 623: n = A,T,C or G
  misc_feature 624, 625, 626, 627, 628, 629, 630, 631, 632, 633, 634, 635,636, 637, 638, 639, 640, 641, 642, 643, 644, 645, 646, 647,648, 649, 650, 651, 652, 653, 654, 655, 656, 657, 658, 659,660, 661, 662, 663, 664, 665, 666, 667, 668, 669, 670: n = A,T,C or G
  misc_feature 671, 672, 673, 674, 675, 676, 677, 678, 679, 680, 681, 682,683, 684, 685, 686, 687, 688, 689, 690, 691, 692, 693, 694,695, 696, 697, 698, 699, 700, 701, 702, 703, 704, 705, 706,707, 708, 709, 710, 711, 712, 713, 714, 715, 716, 717: n = A,T,C or G
gnnnnnnnnnanngnnnnnnnnnnnnnnnnnnnnnnnnnnnnnnnnnnnnnnnnnnnnnnnnnnnnnnnnnnnnnnnnnnnnnnnnnnnnnnnnnnnnacctgggattacaggcacccaccaccacgcctggctaatttttttttgtatctttagtagggttttgccatgttggccaggctggtctttaactcctacctcgtgatccacccgcctcggccccccaaagtgctaggaccacaggcgtgagccaccacgcccagccccctgtctctttttttaaaacacaatttaaaagcagaaagaaaaaatctgtgctgtttagactcagattcttaattagctagtatttcttaattcaatcaataaattattaagaccttttcactgctccctttttaaagtcttctttggagtgatttaagtgcttcttattaccaagctctcaaagagaagataaaattaaaatctgatgggtaaccatttaaataagacaactggggtaacccatttctccaggacccctctctgcaacagagagctattctctttctttggcctagtaaacctctgctcttaacctttaaaaaaaaaaaaaaagtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatccg

SEQ ID NO: 2546 - DNA, 474 bp, Homo sapiens
  misc_feature 243, 267: n = A,T,C or G
ccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctangattcatctttcttttcaccgtangtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcg

SEQ ID NO: 2547 - DNA, 540 bp, Homo sapiens
cataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatg

SEQ ID NO: 2548 - DNA, 587 bp, Homo sapiens
gaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccagtaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcat

SEQ ID NO: 2549 - DNA, 622 bp, Homo sapiens
  misc_feature 491, 541, 556, 561, 568, 578, 585: n = A,T,C or G
accatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccagtaaataacagttatttcatcataaaacagtcccttcaaacacacaattgttctgctgaagagttgtcatcaacaatccaatgctcacctattcagttgctctgtggtcagtgtggctgcatagcgtgggattccatgaaaggagtcattttagtggtggagctgccagtccttcccgggccgggtgtcgctgggccatccttcagtcgtttcgtcataggcgatctgttctgcccgagggttgtggtcaggcaaaattcagccctgaattngggcactctgttcgttgggctaaacccccggttagttcagtcaaggcggnaacccccttgtgggnactgncctggcnttggggtctnggcggtntggccgttggggaggtttggccccacggcctctgtgg

SEQ ID NO: 2550 - DNA, 340 bp, Homo sapiens
aaggcaggaatgtcaggcctctgagcccaagccaagccatcgcatcccctgtgacttgcacgtatacacccagatggcctgaagtaactgaagaatcacaaaagaagtgaaaaggccctgccccgcctcaactgatgacattccaccatggtgatttgttcctgccccaccttaactgagtgattaaccctgtgaatttccttctcctggctcagaagctcccccactgagcaccttgtgacccccgcccctgcccaccagagaacaaccccctttgactgtaatttcccatcaccttcccaaatcctataaaacggccccacccctatctccctttgct

SEQ ID NO: 2551 - DNA, 394 bp, Homo sapiens
aaggcaggaatgtcaggcctctgagcccaagccaagccatcgcatcccctgtgacttgcacgtatacacccagatggcctgaagtaactgaagaatcacaaaagaagtgaaaaggccctgccccgcctcaactgatgacattccaccatggtgatttgttcctgccccaccttaactgagtgattaaccctgtgaatttccttctcctggctcagaagctcccccactgagcaccttgtgacccccgcccctgcccaccagagaacaaccccctttgactgtaatttcccatcaccttcccaaatcctataaaacggccccacccctatctccctttgctgactctctttttggactcagcccgcctgcacccaggtgaaataaacagccatgt

SEQ ID NO: 2552 - DNA, 246 bp, Homo sapiens
tagccctgataggcgctattttcctcctggttttgtatttgaaccgcaaggggataaaaaagtggatgcataacatcagagatgcctgcagggatcacatggaagggtatcattacagatatgaaatcaatgcggacccggggattaacaaacctcagttctaactcggatgtctgagaaatattagaggacagaccaaggacaactctgcatgagatgtagacttaagctttatccctactaggc

SEQ ID NO: 2553 - DNA, 336 bp, Homo sapiens
acatatttccttttcctccattggccacaatgggctccaaacaaccacatgcagattttacaaaaagaaagttccaaaactgctcaatcaaaagaaagattcaactctgtgagatgaatacacacatcacaacgaagtttctcagaatgcttctgtgttgtttttatgtgaagatatttccttttccatcataggcctctaagtgcatcaactatccacttgcagattctacaaaaagagtgtttcaaaactgctcaatcaaaagaaagtatcaactctgtgaggaaatgcacacatcacaaagaagtttctcagaatgattctgtgtagttttta

SEQ ID NO: 2554 - DNA, 518 bp, Homo sapiens
cagaagggtctgcaagatgctgttcttggccactttctttcccacctgggaaggcggcatctatgacttcattggggagttcatgaaggccagcgtggatgtgccagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcaacactttggccctgtatg

SEQ ID NO: 2555 - DNA, 326 bp, Homo sapiens
tctgcaagatgctgttcttggccactttctttcccacctgggaaggcggcatctatgacttcattggggagttcatgaaggccagcgtggatgtgccagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatg

SEQ ID NO: 2556 - DNA, 331 bp, Homo sapiens
acattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaaccg

SEQ ID NO: 2557 - DNA, 253 bp, Homo sapiens
acagaagggatcgaagacaaattgaagggagagatgatcgatctccaacatggcagccttttccttagaacaccaaagattgtctctggcaaagactctaatgtaactgcaaactccaagctggtcattatcacggctggggcacgtcagcaagagggagaaagccgtcttaatttggtccagcgtaacgtgaacatatttaaattcatcattcctaatgttgtaaaatacagcccgaactgcaagttgctta

SEQ ID NO: 2558 - DNA, 356 bp, Homo sapiens
atcgaagacaaattgaagggagagatgatggatctccaacatggcagccttttccttacaacaccaaagattgtctctggcaaagactataatgtaactgcaaactccaagctggtcattatcacggctggggcacgtcagcaagagggagaaagccgtcttaatttggtccagcgtaacgtgaacatatttaaattcatcattcctaaagttgtaaaatacagcccgaactgcaagttgcttattgtttcaaatccagtggatatcttgacctacgtggcttggaagataagtggttttcccaaaaaccgtgttattggaagaggttgcaatctggattcaacccgattccgcta

SEQ ID NO: 2559 - DNA, 570 bp, Homo sapiens
ccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatatttaaattcatcattcctaatgttgtaaaatacagcccgaactgcaagttgcttattgtttcaaatccagtggatatcttgacctacgtggcttggaagataagtggttttcccaaaaaccgtgttattggaa

SEQ ID NO: 2560 - DNA, 223 bp, Homo sapiens
gccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttgg

SEQ ID NO: 2561 - DNA, 337 bp, Homo sapiens
gatgcccataagatatgggaagctatgttatcaagccatattagatatcaagcattaatatggaaataaaccagcctgtttggtgggctcttcacatggacgcgcatgaaatttggtgccgtgactaggatcgggggacctcccttgggagatcaatcccctgtcctcctgctctttgctccgtgagaaacatgcacctatggcctcatgttctcaaaccgaccaaaccaagaaacatctcaccaattttaaatccgcctggcttgtgaggccttttgaccccaattcaagtcttttgataccctgtgaattgcacccatactgcccagatggctag

SEQ ID NO: 2562 - DNA, 473 bp, Homo sapiens
aaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcaactcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatg

SEQ ID NO: 2563 - DNA, 487 bp, Homo sapiens
  misc_feature 7: n = A,T,C or G
actatcncccaggacatgggaccatgctcagctggttgctatcaagaccttgaaagactataacaacccccagcaatggatggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttggcagctcgcaatattttaatcggagaggcaactttcatgttaaaggttttcaggacttgggggctttccagaggaaattttactccgctgatttactacagggtacccaa

SEQ ID NO: 2564 - DNA, 532 bp, Homo sapiens
atagaagtctgggaaaaaaataaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtaaaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaaccttcacttcttcctattgtaatcgtgtgccatggatctgatctgtaccatgaccctacataaggctggatggcaccccaggctgagggccccaatgtatgtgtggctgtgggtgtgggtgggagtgtgtctgctgagtaa

SEQ ID NO: 2565 - DNA, 608 bp, Homo sapiens; identical to SEQ ID NO: 1340

SEQ ID NO: 2566 - DNA, 480 bp, Homo sapiens
tagatgacactgatgattctcaccagtcttatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagcc

SEQ ID NO: 2567 - DNA, 440 bp, Homo sapiens
aggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagggcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactaccgcacatccaaagcgtcagccttcgccttcatggagagcctgaccctggggctgctggactgtccgggagtcagcgccaccacagtgctgcccttccacaccagcaccgagatgttc

SEQ ID NO: 2568 - DNA, 589 bp, Homo sapiens
ggcactgagtgccattacttcatctgtgatgtgggcaaccgggaggaggtgtaccagacggccaaggccgtccgggagaaggtgggtgacatcaccatcctggtgaacaatgccgccgtggtccatgggaagggcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactaccgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcg

SEQ ID NO: 2569 - DNA, 313 bp, Homo sapiens
gcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccact

SEQ ID NO: 2570 - DNA, 223 bp, Homo sapiens
tgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggc

SEQ ID NO: 2571 - DNA, 424 bp, Homo sapiens
ggtacagatttagagcctgtaatcccagctacttgggagtctaaggcaagagaatcccttgaacctgggaggtggagattgcagtgagctgagatcacaccattgccctacagcctgggtgacagtgagactgccccaagaaaaaacaaaagagacagccctagtgatcttgtaagttgcctttggtgggtcagtctttccttttcttaaagaatagtacacattgacagccaggtagctctatgatcctgttctatagaattcaaaaagtcgacaaccttcctttgttcctttctgttttctctgcctacgttagtttaaattggcagtgtctctgctggaataatcccatctctcttcctggcttctgctgagatggctgattaaatccttgggtcacacccattatctctttatcaaatgg

SEQ ID NO: 2572 - DNA, 487 bp, Homo sapiens
ctgtaatcccagctacttgggagtctaaggcaagagaatcccttgaacctgggaggtggagattgcagtgagctgagatcacaccattgccctacagcctgggtgacagtgagactgccccaagaaaaaacaaaagagacagccctagtgatcttgtaagttgcctttggtgggtcagtctttccttttcttaaagaatagtacacattgacagccaggtagctctatgatcctgttctatagaattcaaaaagtcgacaaccttcctttgttcctttctgttttctctgcctacgttagtttaaattggcagtgtctctgctggaataatcccatctctcttcctggcttctgctgagatggctgattaaatccttgggtcacacccattatctctttatcaaatggttgttcaggctaggctcagtgtttcacgcctgtaatcccaacactttgggagactgaggagggcagatcacttgagctc

SEQ ID NO: 2573 - DNA, 492 bp, Homo sapiens
agtcgcgcaccgacgctcaaacgcgcgctccaacccgcagcctcctcctgcctcaccgcccgaagatggcggctctcaaactcctctcctccgggcttcggctctgcgcctctgcccgcggatctggggcaacctggtacaagggatgtgtttgttccttttccaccagtgctcatcgccataccaagttttatacagatccagtagaagctgtaaaagacatccctgatggtgccacggttttggttggtggttttgggctatgtggaattccagagaatcttatagatgctttactgaaaactggagtaaaaggactaactgcagtcagcaacaatgcaggggttgacaattttggtttggggcttttgcttcggtccaagcagataaaacgcatggtctcttcatatgtgggagaaaatgcagaatttgaacgacagtacttatctggtgaattagaagtggagctgacaccacagggcacacttgctg

SEQ ID NO: 2574 - DNA, 494 bp, Homo sapiens
tttttttttttttttttttctccctttataaggcgatgtacataaatctgaggaatatggatgtcttctggagcaaatgctccaatatccacaatttcttcaacctctaccactgtggtttctgcagctttgcacattggcaagttgaaattccttgcacttttcctgaaaatcacgtttcctgctcggtccgccttccaggctttcaccaaagcaaaatcccctgtaattgcttcctccaaaataaagtgctgaccattgaactccctcacctctcttggcttattggcaatggcaacactgccatctttgttgtatttgatgggcgatcctccttcttgtaccagggtcccataccctgttggggtgtaaaatgcaggaactccagccccgcctgcacggatcctctcagcaagtgtgccctgtggtgtcagctccacttctaattcaccagataagtactgtcgttcaaattctgcattttctcccacata

SEQ ID NO: 2575 - DNA, 462 bp, Homo sapiens
catgatgtattacaaggaggccttctggaagaagaaggattactgtggctgcatgatcattgaagatgaagatgctccaatttcaataaccttggatgacaccaagccagatgggtcactgcctgccatcatgggctttattcttgcccggaaagctggtcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtctt

SEQ ID NO: 2576 - DNA, 626 bp, Homo sapiens
catgatgtattacaaggaggccttctggaagaagaaggattactgtggctgctgatcattgaaaatgaagatgctcaatttcaataaccttggatgacaccaagccagatgggtcactgcctgccatcatgggcttcattcttgcccggaaagctggtcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctgaagatcattggatttccacatcagtaactgccctggggc

SEQ ID NO: 2577 - DNA, 348 bp, Homo sapiens
tggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaaga

SEQ ID NO: 2578 - DNA, 207 bp, Homo sapiens
  misc_feature 122, 123: n = A,T,C or G
tcaactcagtggaacacggttctcccaaacagattttgtaattccgaaaaccacgcatgcgcaaacatacgcatacactcccatgttcctggacagtttatagctaccataacctggcattnnccaaaacataccatggtagactcttggatacacaaggtaattttagagccacattaggatgaaccttctgaaaaagttatgcat

SEQ ID NO: 2579 - DNA, 497 bp, Homo sapiens; identical to SEQ ID NO: 631

SEQ ID NO: 2580 - DNA, 275 bp, Homo sapiens
  misc_feature 96: n = A,T,C or G
tgagcttaaggaaaatgacagaatttttgtttctgtaacaaatgagcacttgatagacatggaccatgaagccagttttttcggggcctttttagntggctaactgaccctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaaca

SEQ ID NO: 2581 - DNA, 530 bp, Homo sapiens; identical to SEQ ID NO: 1042

SEQ ID NO: 2582 - DNA, 341 bp, Homo sapiens
gcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgtaatgactatt

SEQ ID NO: 2583 - DNA, 350 bp, Homo sapiens; identical to SEQ ID NO: 998

SEQ ID NO: 2584 - DNA, 171 bp, Homo sapiens
acagaagggacaaagagatctggacagaatcgccggacaggtggcagctgccaacaagaagcattagaacaaaccatgctgggttaataaattgcctcattcgtaaacaaaaaaaaaaaaaaaaaaaaaaagttttttttttttccccccattttttattttttttccccc

SEQ ID NO: 2585 - DNA, 389 bp, Homo sapiens
tggcgctgtgttctatggaggaaaacaaagcaggagaggggagagtgactgctgggtaaggtcttcctccacctcctttgcatctttgctcacatgccagcttctcctgggcttcacagaccaccaatttataatttccatttaaaacttccattttatttttttaatttttatttatttatttatttattacgagatggggtttcgctcttgttgcccaagattgcaccactgcactgcagcctgggtgacagagcgagactttgtcaaaaagaaagaaagaaagaaggaaaggaaggaaggaaggaaggaaggaaggaaaagaaaagaaagggaaagaaaaaagaaaaagaaagaaagaaagaaaaaaaaaaaaaaggggggccccc

SEQ ID NO: 2586 - DNA, 430 bp, Homo sapiens
tgcagatacagtggtggagtggaagtttgcgttggtagagaatgggggagttacccgctgggaagaatgcagcaatagattcctagaaactggccatgaggataaagtggttcacgcatggtgggggattcactgattcagtttgcatagtaatggagaagctgtagaacaatgtggaagaagctgaggttgtggaacacactgaataaaataaaggcagtgtgactccaaattcagccatctgaattgtttaaatttgctagtggattttgtctactgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattacttt

SEQ ID NO: 2587 - DNA, 556 bp, Homo sapiens
ttttttttttttttttttttttttttttaagatattaaaattcaggttttattatttgttcagttataataatttaagttaatatttgctgtattctcagagcaaagatgtatttctgtaccactgtcctgtataaatttgttacccaagatagtgactggtatgaaaggagagggaagagggtgacagatggaaacgattgctgtaggacagtccatctggccagatgcggtgggggaggggagaagaagtgggagagagatggtcctacagatgctcccatgggtaaatgatgggtgcatccctccctgcagtcgggctgtgcctgaacttcacagtcctctaagaggtgtcattcaggccacctcactcagcctatgcccaaccccactcactttccctttccttatgggctgcccccgcaactgacttccatggtgattggttctcattaggccctttgtttctacaccagccttagatcattaagacaaagacgtacttgctaccctcatagcacataacaacgcctggcagatgaaaatcaaacaaaaag

SEQ ID NO: 2588 - DNA, 543 bp, Homo sapiens
tgcagtggacatgtcgggcgggacggtcacagtccttgaaaagtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactg

SEQ ID NO: 2589 - DNA, 242 bp, Homo sapiens
cggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcga

SEQ ID NO: 2590 - DNA, 350 bp, Homo sapiens
tttttttttttttttttttttctttttttttttttttttttttattattaattatcttctttattaatactcacatgtaacctttgctttttacacaaaagtctgctttagaagaatgcctcctcggcttatcatgcccaatggggctttttgtttctggaccacttcccctttctccacccccacccccacatccaaattactcttaacatgttcacagataccacgaatattttgtaaacaagatttgggttactggaacttgatttcattaacatcccacttcaaaatggaaggcaggtggaggacagggtaagaaataggagaaagaggacaagagaaggcaaaga

SEQ ID NO: 2591 - DNA, 448 bp, Homo sapiens
acagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccct

SEQ ID NO: 2592 - DNA, 586 bp, Homo sapiens
aatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatgtcaaaaaaaa

SEQ ID NO: 2593 - DNA, 203 bp, Homo sapiens
aatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcac

SEQ ID NO: 2594 - DNA, 548 bp, Homo sapiens
tgctggaaggcattcgcatctgccggcgagggcttccgcaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgctgcctacctcaagctgcggaactggcagtggtggaggcttttcaccaaagtgaagccactgctgcaggtgacacggcaggaggaggagatgcaagccaaggaggatgaactgcagaagaccaaggagcggcagcagaaggcagagaatgagcttaaggagctggaacagaagcactcgcagctgac

SEQ ID NO: 2595 - DNA, 595 bp, Homo sapiens; identical to SEQ ID NO: 1208

SEQ ID NO: 2596 - DNA, 498 bp, Homo sapiens
tgacagagcaagacttggtttcaaaaaagagaaacacagttggccctccatatctgagtttcacagacgaaaaatattcagaagaaaaaaaaatcaatggctgtatttgtactaaacatgcccaggctttttttcttattgttatcccctaaacaatacaacaactatttttatagcatttacattgtattagatgttataactactctaaagaggatttaaagtatatggaatgatgtgcataggttatatgcaaatactatactatttatatcagggacttgagcatccttggattttggtatgtgtgggaggtcctgaaaccaatgtcctgtggatactgaaggataactgtactaatttggagatttctctctactatgatcaagattttcaaacattacattgctgattacattacatcgttacattgtgattctttccaagacttgagataaagtttgggaagaagtaccacttgtttcagtttatgaaata

SEQ ID NO: 2597 - DNA, 510 bp, Homo sapiens; identical to SEQ ID NO: 1264

SEQ ID NO: 2598 - DNA, 299 bp, Homo sapiens
tggatcccccgggctgcaggaattcggcacgagcagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtgaaaaaaaaaaaaaaaaaaaaaactcgggggggggcccgggccccaattccccct

SEQ ID NO: 2599 - DNA, 234 bp, Homo sapiens
  misc_feature 163, 189, 219, 222, 225, 226, 228, 233: n = A,T,C or G
cagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattnctcaaagtgtgcacaaaactaaagantataaataaacaaaagaaaggtgaaaaaanaanaannanaaaana

SEQ ID NO: 2600 - DNA, 534 bp, Homo sapiens
tgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcagatttgagggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctg

SEQ ID NO: 2601 - DNA, 351 bp, Homo sapiens
tttttttttttttttttttttttctgaaatggcaaatagatttaatgcagagtgtcaacttcaattgattgatagtggctgcctagagtgctgtgttgagtaggtttctgaggatgcaccctggcttgaagagaaagactggcaggattaacaatatctaaaatctcacttgtaggagaaaccacaggcaccagagctgccactggtgctggcaccagctccaccaaggccagcgaagagcccaaatgtgagagtggcggtcaggctggcaccagcactgaagccaccactggtgctggcactggcactggcactgttattggtactggtactggcaccagtgctggcact

SEQ ID NO: 2602 - DNA, 610 bp, Homo sapiens
tttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcactacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctcta

SEQ ID NO: 2603 - DNA, 551 bp, Homo sapiens
tttttttttttttttttttttagcattatcatcttaccctctgtctcaatatacatgttaagaaggtctttccctaactgccagaccaagttggcttcaataggcagctcaacattcaccacctttattttgggctttttagcttctggaggctggtcaacttttttttcatttgctttgtcagcatctgggattttgttttcttctgaggtaagttcaggtgaagggggagactgtgaggtttgttgagcatcagtttgtacctggggctgtgttccagcttcactgttgtcttgctggacatttttatcagtgtctgggttttctggtggtctctgattcagacactccatgtcagcttcagaagacatttcattctcctcagttgggactttctccaccatagatgccgtagagatggtgaaaatgccatgggtgttgactcgcactttgacttttactctagatttttctccatctttctgtgcagaaacattctgaactacaaagcggcctatttttgcttctggatatggaactccttggggatc

SEQ ID NO: 2604 - DNA, 550 bp, Homo sapiens; identical to SEQ ID NO: 424

SEQ ID NO: 2605 - DNA, 300 bp, Homo sapiens
ctaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcg

SEQ ID NO: 2606 - DNA, 583 bp, Homo sapiens; identical to SEQ ID NO: 1532

SEQ ID NO: 2607 - DNA, 517 bp, Homo sapiens
cccggaaggcgacgggaaggagccgagcttgggtcatggcggcgccgggcgcgctgctggtgatgggcgtgagcggctcggggaaatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctcc

SEQ ID NO: 2608 - DNA, 590 bp, Homo sapiens
ttttttttttttttttttttttttttactagcgaagtttcatttatttgtgcaaatacaggcatgagcaagaatgttctaaacaatgtaacgatttccagcattgattacagaatttcctctgatcatttgatttggttatagatgaatttaaacttcaatttaagcttgacttttaaaactccccctctgcttcctgatgaaccagcataattcctaaaattacacctaaacaagtctgtcttgacacattggggtttgcctttagaaacatttagaatctattatgggcaaggcggctggaacgaggtttgggatggcacaatgatttatgcttagttctgtttggaccactgatacaaaatcattgtcatttcatttttagggtttccataattgtagcaattatctctgaaacatttttgtccacacttatttggataaagttttctggagctgctgggggctccagagtctcaaactgggactgcaataattcagggggcataaaatgtccctctcttttgagtaagcgtccagagatgacctcaaacgacccgctcagatggaccaccaggagctgcatctcag

SEQ ID NO: 2609 - DNA, 116 bp, Homo sapiens
gacacttacaaattgctgcttgtccaaatcaggatccactgcaaggaacaacaggccttattccactgctggggattggtgtgtgggagcacgcttactaccttcagtataaaaat

SEQ ID NO: 2610 - DNA, 574 bp, Homo sapiens
ttcttttttttttttttttttttgcacaaagcatttactattttcaatcacttgcccaataacaaaatgtttagtaagaaattattcagaacattaagttgtttatgaaataagtgactaagcaacatcaagaaatgctacaatagagcagcttactgtattctgcagtactctataccactacaaaaacagtcataaagagcttaacatactcagcataacgatcgtggtctactttttgcaagccatgtatctttcagttacattctcccagttgattacattccaaatagcttttagataatcaggcctgacatttttatactgaaggtagtaagcgtgctcccacacaccaatccccagcagtggaataaggcctgttgttccttgcagtggatcctgatttggacaagcagcaatttgtaagtgtccccgttccttattgaaaccaagccaaccccaacctgagccttggacaccaacagatgcagccgtcagcttctccttaaacttgtcaaaggaaccaaagtcacgtttgatggcttccagcaactcccctttgggttctccacca

SEQ ID NO: 2611 - DNA, 474 bp, Homo sapiens
ttttttttttttttttttttttgggggggtgacagattcttttattaacagtcaaaaacttcacacaattggaaaataaatgtttcttcaatgaataatcaaacaaaaattatccaggaccttatagggttttcagtatgtaccaggcttgatgcacatcttagaagacaggacattatcttgctgggatcattagggtatgatcagcataacgatcgtggtttactttttgcaagccatgtatctttcagttacattctcccagttgattacattccaaatagcttttagataatcaggcctgacatttttatactgaaggtagtaagcgtgctcccacacatcaatccccagcagtggaataaggcctgttgttccttgcagtggatcctgatttggacaagcagcaatttgtaagtgtccccgttccttattgaaaccaagccaaccccaacctgagccttggacaccaac

SEQ ID NO: 2612 - DNA, 526 bp, Homo sapiens
gggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagcta

SEQ ID NO: 2613 - DNA, 344 bp, Homo sapiens
gaacccggggcgcggcgcactgcgcatgcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgggggggagcttctctctgtgtatttctcgccatgacctgttcagtgacaccc

SEQ ID NO: 2614 - DNA, 332 bp, Homo sapiens
gaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggaggagattctctttgtgtattttttgccatgacttgt

SEQ ID NO: 2615 - DNA, 545 bp, Homo sapiens
cggctgcgagaagacgacagaaggggagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaac

SEQ ID NO: 2616 - DNA, 329 bp, Homo sapiens
gagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgaggaggtgtttctctttgtgtattttttgccatgacttgttcgctgatatctaaatttacaagttggatcttgagtgaaa

SEQ ID NO: 2617 - DNA, 284 bp, Homo sapiens
gcgcggcgcctcgcctcggccggcgcctatcagccgacttagaactggtgcggaccaggggaatccgactgtttaattaaaacaaagcatcgcgaaggcccgcggcgggtgttgacgcgatgtgatttctgcccagtgctctgaatgccatattaaaaataaactttaaaatttaaaagggggccgtttttctctgattcccaccccgttaaaaacccttttggggggggggccccccccccctcatggggcggggaaaaaaggccttttttgggaaatttggg

SEQ ID NO: 2618 - DNA, 522 bp, Homo sapiens; identical to SEQ ID NO: 1160

SEQ ID NO: 2619 - DNA, 510 bp, Homo sapiens
gttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagcccgctccggaacttgtcatctccaacgacaaaaggagcttttgccactgactcggccgtgtcctgacacctccagaacgcaggtgctggcgcccgttctgcctgggaccccgggaacctctcctgcc

SEQ ID NO: 2620 - DNA, 385 bp, Homo sapiens
aatagtctgtgtccaagaaaataagaatcacgtcatctagctgtggacactgagcaaaaaggagcagcatgctattaagatggttgagacacacgagtgaacaaagatgggacaaactgtgcttcgttcaagaagtttcatcaagacccctaccgccccccgtccttcagctctgtacagtaactttagctttacatagagctgagataaaaataaagctttcttacaaattacatttttttccagtgaattacttttgcagtaaaaatagctgctacataaatccctcctgatctctgaaaaggagttgcatatttccaaaaataatattcttattttaatcacacagaagaacgtggagcacaggaaggaaatggctggctgg

SEQ ID NO: 2621 - DNA, 645 bp, Homo sapiens; identical to SEQ ID NO: 1510

SEQ ID NO: 2622 - DNA, 500 bp, Homo sapiens
atgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaggctggcctgttttctaaaggaagatgattgccacaaggcaagaagatgcatctttcttcctggtgtacaagccttt

SEQ ID NO: 2623 - DNA, 592 bp, Homo sapiens
taaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaggctggcctgttttctaaaggaagatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttcca

SEQ ID NO: 2624 - DNA, 197 bp, Homo sapiens
ggccgcccttttttttttttttttttttttttttttttggggaaaagggggtcttttttgggtcccccccccccttttaaaaaacccccctaaaaaatgcccccaaaaaaaaaaatttttttttttggggggggggaaaaaaagggggaaaaaaccccccccccccggggggggaaaaaaacccccccaaaaccccc

SEQ ID NO: 2625 - DNA, 493 bp, Homo sapiens
ttttttttttttaatggtaaaaactttatttactatttataaatacattgcaagacaaacttctcaaaaatacttttccccccaaaaagttaaaaaaataaagaaaagctaataggtaggcagaatgtcttgagacccctctgttttcaaggagagctctatgcagcgtgtgtccacaccgaggtctgcagcagggcagagtctccctgagcctgactttgccagaccttcttgggtttggcctccgggagagcagcccagtctctgggtcgacgtcctttcctcagtcatggccacagttgtatcatatagcatctctaacatttcatctaggattatctagtatagatcttactatatttggggctatgttgtatacaatgttaacaagaacatatcttctctgcatatatgtgtgaattataaagaaaagcatgagaatgactctaagttcaacaaacatgggtgaatctctatgtgctcccagtgtcct

SEQ ID NO: 2626 - DNA, 265 bp, Homo sapiens
tggtacgcctgcagtaccggtccggaattcccgggtcgacccacgcgtccgcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaacctttttttttaaaaaaaaaaaaaaaaaa

SEQ ID NO: 2627 - DNA, 186 bp, Homo sapiens
tttctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaacc

SEQ ID NO: 2628 - DNA, 475 bp, Homo sapiens
cagcccgtccgcggcctctccagccccgggttcgcgctctcgactcccccgacccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttc

SEQ ID NO: 2629 - DNA, 122 bp, Homo sapiens
agaagggttgctggagcctaggacgtcgaggctgcagtgagatatgatcacaccactgcactccagcatgactgagtgagaccctgtctcaaaaaaaaaaaaaaaaaagttttttttttttc

SEQ ID NO: 2630 - DNA, 147 bp, Homo sapiens
ggaggggaaggttggtaggtaagctgtaacagattgctccagttgccttaaactacgcacatagctaagtgaccaaacttcttgttttgatttgaaaaagtgcattgttttcttgtccctccctttgatgaaacgttaccctttgac

SEQ ID NO: 2631 - DNA, 607 bp, Homo sapiens
cagtgaagacttgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactacgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaat

SEQ ID NO: 2632 - DNA, 463 bp, Homo sapiens
attccaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacaga

SEQ ID NO: 2633 - DNA, 592 bp, Homo sapiens
ccaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactat

SEQ ID NO: 2634 - DNA, 251 bp, Homo sapiens
caattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacattt

SEQ ID NO: 2635 - DNA, 229 bp, Homo sapiens
gtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttgga

SEQ ID NO: 2636 - DNA, 316 bp, Homo sapiens
cgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatgga

SEQ ID NO: 2637 - DNA, 270 bp, Homo sapiens
  misc_feature 37: n = A,T,C or G
agtcgccataacctggtcagaagtgtgcctgtcggcngggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgc

SEQ ID NO: 2638 - DNA, 341 bp, Homo sapiens
ttacatacgtttttattactcgggggggacctgtacgtcaccaatgcccagcttcacgggggcatgtagtgtgactcacggctgaacacaaaatcactgtgaagcctgtgctacagaaggatgtccagtcgctgaggccaggagagaggtgggcaggcctgggtctggcagtggagacggtcctccagggagccgttgggcaggaagccgtacaccaggcagtagaagccgttctgagcacagtagccagcaaagtccacaatgtttgggtgacgaaacctggacagctgctccacctcggtcaggaagctctgcttcactgcagtccactccaggtcagc

SEQ ID NO: 2639 - DNA, 466 bp, Homo sapiens; identical to SEQ ID NO: 1346

SEQ ID NO: 2640 - DNA, 70 bp, Homo sapiens
agttttcctttttttaataattatttttaatttaaaaaagcaaatggaaaatgtatattttgatgagctt

SEQ ID NO: 2641 - DNA, 442 bp, Homo sapiens
tttttttttttttttttcggctcagtataaagcttccttttcttagggaccatgcaaagattctttgattctagaagtgccatttcattatttctgtgactcctgtctgaatcatctgccaggtaactatcttgattttgtcttagcaatcgacttagcagaccattcttggagaaagaaaaatcctgaggtgaaacaggctccgatttaaagtcttcggacactggtaaggcaggtgcgcttctctgcacagcaggagccatacccaagaatggggcactcttagcatcatggctcaagtgcacatttgtgttaggaatttgtaagtcatcacaaggctcagattttattttcaccatcagtatttgttcacttaaagctctctctgagtgttcctgagtactttcatctcttaagggagttttctcttttttttcactct

SEQ ID NO: 2642 - DNA, 275 bp, Homo sapiens
  misc_feature 244: n = A,T,C or G
agaaaaatacaaaaaatctgcattaaaaatattaatcctgcatgctggacatgtatggtaataatttctattttgtaccattttctgtttaactttagcatgttgttgatcatggatcatactcccctgtttcttgggtgagaagggatcgccagtttggaaactccggcggctgcgtgcggggtttcagtcccactgtaggcttgtaaataccgccccgccaaaccgcatagagacgtggcancactgagggctttgttgggttatatacgtat

SEQ ID NO: 2643 - DNA, 353 bp, Homo sapiens
taagctcggaattcgggtcgaggaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaaaaaaaaaaaaagggggggccccca

SEQ ID NO: 2644 - DNA, 559 bp, Homo sapiens
gaatttggccctcgaggccaagaattcggcactagggcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacg

SEQ ID NO: 2645 - DNA, 711 bp, Homo sapiens
  misc_feature 444: n = A,T,C or G
tttttttttttttttttttgacacccataacagctttattttcaaaggcgggatccctccccgggcttgtgatgggacggcgctgtgggcccgagcagcaaagccgtgcaggacaggcatgggcaggggtggggcagctggcccgggaggccggcaggtcccaaaagacacctcacacgggttccatctgcagctcctccccgtccacagcctcaatctggtggaaggcagcgtgggagccgatgaccaccagggtggctcccagcacccagaagacggccgagcccgcaccagccagccagaagaaggggaaggagatgcctccagccagagcatactgatgcgctgggctcacctctcggccaaagagcacaagcttggactccaaggtgcgcagatagagaatgtaacaggcgccgaaaaagaccagccagagccaccagncacataggggacgtcaccacacagtacaggatgaggcccaggaacacgaacacatagttgctctggtagtactccacgttgcgtacgaggcgctggcacagctctcccaggttgcggggccgtgagaagcgctgctggtccacgaaggtgctccaggggccggatggtcgcgcggcgccgctccagccactcccggcctgcacccggaggaatcagcttcggcagcaaggtcgtgccggtcagcccttccgcctcggcattctttct

SEQ ID NO: 2646 - DNA, 468 bp, Homo sapiens
actcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatc

SEQ ID NO: 2647 - DNA, 203 bp, Homo sapiens
cgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgt

SEQ ID NO: 2648 - DNA, 212 bp, Homo sapiens; identical to SEQ ID NO: 668

SEQ ID NO: 2649 - DNA, 226 bp, Homo sapiens
  misc_feature 109, 128, 153, 161, 167, 174, 175, 178, 196, 202, 206, 211,213: n = A,T,C or G
gaagcacctcattgtgaccccctcgggctgcggggaacagaacatgatcggcatgacgcccacggtcatcgctgtgcattacctggatgaaacggagcagtgggagaanttcggcctagagaagcggnagggggccttggagctcatcaaganggggtacncccagnagctggnnttnagacaacccagctctgcntttgcnggcnttcgnanaaagggcccccac

SEQ ID NO: 2650 - DNA, 97 bp, Homo sapiens
ctgggctgcggctgatgcgcatccgttttcctgccctgggcatgtgtctctgaaaccgtatggcgggcggtgggcaacgggcactgctaagggaggc

SEQ ID NO: 2651 - DNA, 120 bp, Homo sapiens
ggcacgagctcatctgtttgcggatcagaacccgagctgtgcttgtggctgcggctgctaactggctgcgcacagggagctgtcaccatgcctcactcgtacccagccctttctgctgag

SEQ ID NO: 2652 - DNA, 273 bp, Homo sapiens
ggccgcccttttttttttttttttttttccccccttttttttggtgggggggtttttccaaggggttgaatgggggttttttttccccccttttaccccagaaaaagggggaggaaaaaaggaacccccggggaaaattttcctttttttggaaaatttgggggacccgaaaaagggggggggaacccccccccttttttttttcttttaaaaaatttttttgcccccaaaaaaaggggggccccctttcccccccttcttgggccccggggg

SEQ ID NO: 2653 - DNA, 90 bp, Homo sapiens
cacttcatgcaaggcacatgtgctgtcctgcaggtctgcagggaaccgacccagagagcccagcggcaggccctggaacacccgcctctg

SEQ ID NO: 2654 - DNA, 463 bp, Homo sapiens
gacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatc

SEQ ID NO: 2655 - DNA, 693 bp, Homo sapiens
  misc_feature 285, 455, 597, 606, 636, 667, 686: n = A,T,C or G
ggcacgaggagagagagagtcacaagatgatcgacttgttcgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcanaccgcgccaagaagaagtgacgctggagccccgggtcctggctgccacctgccctgggagtcttgctgtgccacacagctccccaccccctgctaggaggtcccagtctcacgccttcctcatgtgttgttctacctgctgggatgggggtcagcctctctttggtgacntcacgttcttctgggatcctgaggaccgggcctcaaatcagggaggatacccgggagggccccttcatccaagcggtgcttctggggtgccgggaccgggcagtgtcacaccctgcctgctagtcctggggtccagatctanggaccttantgaaggagtggtgtgaggcagttctgaagnggataactcgcccacaacaagttgggacatncagaggaaactcaactctnacgtctt

SEQ ID NO: 2656 - DNA, 300 bp, Homo sapiens
gagagagagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgc

SEQ ID NO: 2657 - DNA, 300 bp, Homo sapiens
  misc_feature 37, 41: n = A,T,C or G
gacttgtccgggaatccggtgcttcggatctactacncctngaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgccc

SEQ ID NO: 2658 - DNA, 239 bp, Homo sapiens; identical to SEQ ID NO: 11
  misc_feature 168, 190, 203, 229: n = A,T,C or G

SEQ ID NO: 2659 - DNA, 113 bp, Homo sapiens
gacacatttgttacttcgtgagcaagcccggaggctcggagccccctgccgtgttcacaggtgacaccttgtttgtggctggctgcgggaagttctatgaagggactgcggat

SEQ ID NO: 2660 - DNA, 294 bp, Homo sapiens
ttttttttttttttttttttttttggcgggaataaatacttgttaaacttctcttataaatatgcattaaaacgtccgataacacaagccaagggctgtaaaattaaggttaaatcaagactgaatttcccgcacggaccagcaggaaagccagttacctaaaagagcctaatccccaaatccgctgaaggtgcagggcggcctcagtcccggggcatcttgaactggtccttctccctgcgcacggcccgcatggtggtcaccgggtccgtctcacctgcgtgctgctgcacc

SEQ ID NO: 2661 - DNA, 419 bp, Homo sapiens
tagccatggcaggacagctcctggaccaggtctcataatgcatgtggcacttaggtccaagctctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatagagcccagaaaacggaggatgggggtggggcgccttcctggaggtgacacttgatgggg

SEQ ID NO: 2662 - DNA, 357 bp, Homo sapiens
cgtattgctgtcaagccgtgagctagccatggcaggacagctcctggaccaggtctcataatgcatgtggcacttaggtccaagctctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctc

SEQ ID NO: 2663 - DNA, 408 bp, Homo sapiens
actttgtatcactgcagcgcttcacaccttcatcctgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgccccaggctctgtctcctcagctcatttcttactctttttctctatataactcattctattaaatacattgca

SEQ ID NO: 2664 - DNA, 550 bp, Homo sapiens
acaaggacgccaaccccacctagatgcaaagcaggattcaaaagaacatctttgcgttttctaccggctccccatcatcgtactagggaggaagaagcgggtgagaaacaaaacttctttccattgtcctgcccttttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggc

SEQ ID NO: 2665 - DNA, 554 bp, Homo sapiens; identical to SEQ ID NO: 1255

SEQ ID NO: 2666 - DNA, 313 bp, Homo sapiens; identical to SEQ ID NO: 1495

SEQ ID NO: 2667 - DNA, 519 bp, Homo sapiens
cggccgcccttttttttttttttggccccccggggcccccttattttaaaaaccccccccccccctggggggggggccccgaccttttaagttttttttttttcccccgggggaaaaaaaggggggaaaaaaaaaaaaaattcccccccctttttcccccccccaaaaaagggggggaccccccgggggggggggggtttccccgggggggaaaaaaaaaacccccgggggcccccccccaattttttcccccccccccttggggggggggggggggggggggggggggggggggcccccccccccccccccccccccattttggggggttgggttgggggaaatttttttttaaaaaaaaaaaaaaaaaatttgggggtccccccccccctttttttccccccccttttttccaaaaggggaccccccccccccccccccaaaaaaaccccccccccccccccaaaaaaaacccccccccggggggggaaaaaaaagggggggggggggggccccccc

SEQ ID NO: 2668 - DNA, 422 bp, Homo sapiens
aactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggc

SEQ ID NO: 2669 - DNA, 626 bp, Homo sapiens
tacggccgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcatccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaggctctgccaccagcgctcccgggactactcggccatgatcaagcacctgagaacgcacaacggcgcctcgccctaccagtgcaccatctgcacagagtact

SEQ ID NO: 2670 - DNA, 515 bp, Homo sapiens
gatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcatccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaggctctgccaccagcgctcccgggacta

SEQ ID NO: 2671 - DNA, 615 bp, Homo sapiens
actgttcaaggtttattgggggttttagttggtataacacttggatagttggttgcattgtttgtatgtagatctttttacattatatggtaatgtacactactgatatagttcacaaaataagatcctttggaagaattatgcacaagacatgatattggatttatacactggatcccaggatgtgactcactgggaaaaaatgttggactaggcatgttcagtgaaggagccaggaagttatataacacacggtaaacatccacctggctcaaggggcaaatgcagtacgtacagcattggcagtggtgcgtcagaggtggcagaactatttcacactaaccagttgaagactacacaagattaataccatccagcatcaggatatagctgtggattttacaaaccattcttatttctaacttcaggagttgatgtttttcccagtccatcttaaaatattactgctttaatcacagatcagataaaaaggacaacatgcacaacctccacctagaatcctgttgtagcctagacagtgaaatgatatgacatcagaagactttaaaattgcagctccttttggatcccccaaagtgtatctgcactcttctt

SEQ ID NO: 2672 - DNA, 99 bp, Homo sapiens
ttttttttttccactgttcaaggtttattgggggttttagttggtataacacttggatagtgggttgcattgtttgtatgtaaatctttttacattata

SEQ ID NO: 2673 - DNA, 612 bp, Homo sapiens; identical to SEQ ID NO: 1163

SEQ ID NO: 2674 - DNA, 410 bp, Homo sapiens
gaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgtccaagctcagttcaatgagcaaatctccatactgtttctttctttttttttcattactgtgttcaattatctttatcataaacattttacatgcagctatttcaaagtgtgctggattaattaggatcatccctttgg

SEQ ID NO: 2675 - DNA, 310 bp, Homo sapiens
gctcgggaattcgctcgagtgctgctccccacccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccct

SEQ ID NO: 2676 - DNA, 257 bp, Homo sapiens
tgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactgactttctccaaacaggatttgcctcctccacgctccctacacacctgagatgtaaactggcagtcagtgttcactcaggacctaggattagaaaatggcagagtt

SEQ ID NO: 2677 - DNA, 593 bp, Homo sapiens; identical to SEQ ID NO: 583

SEQ ID NO: 2678 - DNA, 304 bp, Homo sapiens
  misc_feature 106, 113, 125, 137: n = A,T,C or G
gggtcaaagttgagctgaagaacggtgccacttacgaagccaaaatcaaggatgtggatgagaaagcagacatcgcactcatcaaaattgaccaccagggcaagcngcctgtnctgctgcttggncgctcctcaganctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactc

SEQ ID NO: 2679 - DNA, 258 bp, Homo sapiens
ggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtct

SEQ ID NO: 2680 - DNA, 442 bp, Homo sapiens
aagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaagggtatgtcagatggctttatctctaaccta

SEQ ID NO: 2681 - DNA, 611 bp, Homo sapiens
gggctgaggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaagggtatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctacggctgaggact

SEQ ID NO: 2682 - DNA, 416 bp, Homo sapiens
ttacaaactcctgaaccataatattctcgtctccacagacacatactccataatttaaaaccaaatgcttgtgagaaagcttgctcatcatacttgctgcttcaaagaaagactctgaatagtttctgtgtgctttatccagaacttttaaaagaacttctgtttcatgcagttgaccgtagtctcctacttctcttcgtacgcctttaaaaatctttgtaaaagtgccttggccaaggctttcattaaatatcaaatcttcatttctgattttgtgaaacaccatttggttcatatgagtaggcctctgtaatgttggtgaggttggtacatcagaaacaccattcgttctgaagactagaaggtttgatttatcttttcggctttgggggacagcatttagtacacgggaaaat

SEQ ID NO: 2683 - DNA, 163 bp, Homo sapiens
gggctttttttttttgcaaagttccaaatttatgggtcgggaaataaatccaaatttctcattaaaaaactcctttggaaaaacttgggcccaaaagtttcccatccgaactcagccttttttgccccgatccccgacttttttactcaaggcccgggaaggc

SEQ ID NO: 2684 - DNA, 285 bp, Homo sapiens
aaagttacaaatttattggtctggaaataaatacaaatatctcattaagaaactcctctggaaagacttgtgcacaatagtttcccatccgtactcagcctctcttgccccgatccccgacttttctactcaaggccagggaaaggcctccaaggtgatgggcggcaggtaacgagtcattgcctctcacgccacctggaaggctggactacttcctcctcccaactgcggggtcccagaaatcctcgggtcccagtggctgacttacaatattcaattcactct

SEQ ID NO: 2685 - DNA, 458 bp, Homo sapiens
tcgagccgccgccgcccctgtacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcctttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttc

SEQ ID NO: 2686 - DNA, 329 bp, Homo sapiens
tttttttttttttttttttttttctttttaataactatcaactcaaacttagggaaacttgcctttgtcttgggggaaaaaaacaactagacaataaagcttcttttacatcatttgctaacctgatctcgttttaagagagagatggtagttatgttgcaagagtaaaatttataccatgaatgatacaggtctagtctggtggcactaattagagataatagcattgctgacaaaattataatctgctggtggcatttgcggaaaagaggcccttgcaaatttctaaacaacagtaaactctgttaggaaattctaaaatgtcttca

SEQ ID NO: 2687 - DNA, 527 bp, Homo sapiens
atacatgtaacttcattattttaaaaatatttttagaactccaatactcaccctgttatgtcttgctagtttaaattttgctaattaactgaaacatgcttaccagattcacactgttccagtgtctataaaagaaacactttgaagtctataaaaaataaaataattataaatgtcattgtacatagcatgtttatatctgcaaaaaacctaatagctaattaatctggaatatgcaacattgtccttaattgatgcaaataacacaaatgctgcaaagaaatctactatatcccttaatgaaatacatcattcttcatatatttctccttcagtccattcccttaggcaatttttaatttttaaaaattattatcaggggagaaaaattggcaacgctattatatgtaagggaaatatatacaaaaagaaaattaatcatagtcacctgactaagaaattctgactgctagttgccataaataactcaatggaaatattcctatgggataatgtattttaagtga

SEQ ID NO: 2688 - DNA, 530 bp, Homo sapiens
atacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtga

SEQ ID NO: 2689 - DNA, 253 bp, Homo sapiens
  misc_feature 98, 141, 162, 213: n = A,T,C or G
tatacatacatgtaacttcattattttaaaaatatttttagaactccaatactcaccctgttatgtcttgctaatttaaattttgctaattaactganacatgcttaccagattcacactgttccagtgtctataaaaganacactttgaagtctataaaanataaaataattataaatatcattgtacatagcatgtttatatctgcaaaanacctaatagctaattaatctggaatatgcaacattgtcct

SEQ ID NO: 2690 - DNA, 421 bp, Homo sapiens
ccgttgctgtcgatcccagctccttgggaggctgaggcgggagaattgcgggaaggcggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttaaatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggat

SEQ ID NO: 2691 - DNA, 377 bp, Homo sapiens
cagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctc

SEQ ID NO: 2692 - DNA, 243 bp, Homo sapiens
  misc_feature 228: n = A,T,C or G
gaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatntgaaagttcaggggt

SEQ ID NO: 2693 - DNA, 544 bp, Homo sapiens
tattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgc

SEQ ID NO: 2694 - DNA, 244 bp, Homo sapiens
  misc_feature 210: n = A,T,C or G
cacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagtncaccacgcccgatggccattatacgacatcctgg

SEQ ID NO: 2695 - DNA, 209 bp, Homo sapiens
  misc_feature 140: n = A,T,C or G
gaacactgttgctcttggtggacgggcccagaggaattcagagttaaaccttgagtgcctgcgtccgtgagaattcagcatggaatgtctctactatttcctgggatttctgctcctggctgcaagattgccacttgatnccgccaaacgatttcatgatgtgctgggcaatgaaagaccttctgcttacatgagggagcacaatcaat

SEQ ID NO: 2696 - DNA, 254 bp, Homo sapiens
  misc_feature 85, 100, 143, 155, 182, 203, 229, 245, 254: n = A,T,C or G
ctcccaaccaagctctcttgaggatcttgaaggaaactgaattcaaaaagatcaaagtcctgggctccggtgcgttcggcacggngtataagggactctngatcccagaaggtgagaaagttaaaattcccgtcgctatcaangaattaagagangcaacatctccgaaagccaacaagganatcctcgatgaagcctacgtnatggccagcgtggacaacccccacgngtgccgcctgctgggnatctgtctn

SEQ ID NO: 2697 - DNA, 484 bp, Homo sapiens
tttttttttttttttttttcaaatatacctctttgaaagataaatttctgctcaaagggacaatattcttgctggatgcgttcctgtaaatgcttcacagtttgaagacaaaggaatgcaacttcccaaaatgtgcccgaggtggaagtacttcctggctagtcggtgtaaacgttgcaaaaccagtctgtgggtctaagagctaatgcgggcatggctgttgggatggaggacctgctgtggcttggtcctgggtatcgaaagagtctggatttttagggctcatactatcctccgtggtcatactccaataaattcactgctttgtggcgcgacccttaggtattctgcattttcagctgtggagcccttaaagatgccatttggcttggcttccttgggaaagaagtcctgctggtagtcagggttgtccaggctaatttggtggctgcctttctgggcccagtgggcagggctgtcgaat

SEQ ID NO: 2698 - DNA, 660 bp, Homo sapiens
tttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagt

SEQ ID NO: 2699 - DNA, 277 bp, Homo sapiens
ctttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgt

SEQ ID NO: 2700 - DNA, 457 bp, Homo sapiens
gactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggta

SEQ ID NO: 2701 - DNA, 361 bp, Homo sapiens
tttttttttttttttttttttttgggcaggagaccatgttactttattcatttgtttaactttaaccatgttcaataaacttttcacctgtttggtgagttccacaaaagccttagagagtttctggtagtaaccttctatagttgcctttccatatcggccacccgtgtttcgacaatacaccatgtagtgcagctggggtgttgttaacaagccataatcatggaattgacctcctagaacagtcacaccatctattacagattgtgaaagtttctcactgctgggcctggtatctctaccaataactacaaaggcatcttgttgcagattcacagcttctttctcgctgatgtcaata

SEQ ID NO: 2702 - DNA, 551 bp, Homo sapiens
gagccgagctgatttgatcgaggagcgcggttaccggacgggctgggtctatggtcgctccgcgggccgctccgccggctggtgcttttttatcagggcaagctgtgttccatggcagggaacttttggcagatctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatgga

SEQ ID NO: 2703 - DNA, 637 bp, Homo sapiens
tacggccgggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacat

SEQ ID NO: 2704 - DNA, 130 bp, Homo sapiens
tagaaagcctccacctggagtacaatgccctcaaggtccttcacaatggcaccctggctgagttgcaaggtctaccccacattagggttttcctggacaacaatccctgggtctgcgactgccacatggc

SEQ ID NO: 2705 - DNA, 372 bp, Homo sapiens
  misc_feature 29, 100, 297, 298, 353, 357: n = A,T,C or G
gtgctgtttgaccaatggtcatgtggccnagattggggacttcgggctggctagggacatcatgaatgactccaactacattgtcaagggcaatgccgcnctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgcccnnaagaatatatacagcatcatgcaggcctgctgggcttgggagcccacccacaganccancttccagcagatctg

SEQ ID NO: 2706 - DNA, 478 bp, Homo sapiens
  misc_feature 3, 10, 11, 78, 112, 130, 150, 231, 457: n = A,T,C or G
gancacctgnnacaaggaggatggacggcccctggagctccgggacctgcttcacttctccagccaagtagcccaggnatggccttcctcgcttccaagaattgcatccacngggacgtggcagcgcgtnacgtgctgttgaccaatggncatgtggccaagattggggacttcgggctggctagggacatcatgaatgactccaactacattgtcaagggcaatgccgcnctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactgggtgaaaggatggataccaaatggcccagcctgcattttgcccccaaagaatatatacaagcatccatgnaggcccttctgggccttggag

SEQ ID NO: 2707 - DNA, 218 bp, Homo sapiens
gcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggagg

SEQ ID NO: 2708 - DNA, 556 bp, Homo sapiens
taagctcggaattcggctcgaggcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttgga

SEQ ID NO: 2709 - DNA, 319 bp, Homo sapiens; identical to SEQ ID NO: 439

SEQ ID NO: 2710 - DNA, 456 bp, Homo sapiens
attccgttgctgtcgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgcctggcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccatta

SEQ ID NO: 2711 - DNA, 533 bp, Homo sapiens
agtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctaaaagtcttaatatgggctgttgccatgaaggcttgcagaattgagtccattttctagctgcctttattcacatagtggacggggtacctaaaagtactggggttgactcagagagtcgctgtcattctgtcattgctgctactctaacactgagcaacactctcccagtggcagatcccctgtatcattccaagaggagcattcatccctttgctctaatgatcaggaatgatgc

SEQ ID NO: 2712 - DNA, 246 bp, Homo sapiens
aatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacac

SEQ ID NO: 2713 - DNA, 407 bp, Homo sapiens
ggccgcccttttttttttttttttttttttttttttttgggcaaaaaggggcttttttttttttccccccccctttttttaacccttcccctaatatttcccccaaaaaaaaaaattttttttttttgggggggggaaaaaaaagggaaaaaaaacccccccccccggggggggaaaaaaaccccccaaaaaccccccttttgggggggtccccccccatgggggttccccccccaatttttttcccccccccaaaaaaatttttaacccccccccaagggggtggaaaaccttaaaaaaaaccccccggaaaaaccaaaaccccttttttaaaaaaaaaaaaaaaatttttggggggcaaaaccccccccccccaaaaaacccccccccccccccttaaaaaaaaa

SEQ ID NO: 2714 - DNA, 359 bp, Homo sapiens
  misc_feature 1, 53, 121, 123, 128, 133, 142, 150, 174, 179, 183, 186,196, 200, 201, 204, 207, 212, 215, 218, 224, 229, 230, 231,243, 244, 249, 260, 261, 267, 268, 270, 273, 279, 289, 291,295, 301, 303, 305, 312, 315, 337, 345, 357: n = A,T,C or G
ncggggactgcgcggcggtgcagagccgggcgtgggcgagaacgaacgggctncctgcggctgagagcgtcgagtgtcaccatgggtatcacgcttggagcttcctaaaggacttcctggncngggcntcgcnctgcccgtntccaagancccggtcggccccaatcgagaggncaaanctgntgntgaaggtgcnagannccnagnaacangtnaantcttangaagnnntacaaaggggtnnattanttttttggtannattccnnangancaaggntttcctttcntnttgnagggtnancntggcaangtnattccttaatttcccaaccaangttttaantttggctttaangg

SEQ ID NO: 2715 - DNA, 394 bp, Homo sapiens
ttttttttttgcattaagtggtctttattgatgtttcacattcagttattatcaattcttcagttaattgtacaagtatgataaattattttctatttgctgtgggaatttaaatgtaaaataaatacaaaatacatgtgtggtttaatgaacactcaatgaagcatctcttctgaggtattcctttcagtctggttttatcccaggatctttttacttcccctaggaatagtctattaaaccacacaatggatctgtgaacttgtagatcaagttcactgtaaatctgtgaacttgtgttttaattacattagacatattttttgatctcatcatacaacaccaatacaaaaggcaccgcccatgcctctcaggcacattgggaccgggcacc

SEQ ID NO: 2716 - DNA, 292 bp, Homo sapiens
gggagcccaccagcaagaatgagttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatttgagcgattgctctgtgaagagttgtacactgaacactttcaggggaggctgtttacccaggcaatgtcctcaaacaagcctgtgccggggtgtcctgga

SEQ ID NO: 2717 - DNA, 495 bp, Homo sapiens
aattccgttgctgtcgctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaat

SEQ ID NO: 2718 - DNA, 358 bp, Homo sapiens
tgcgaccgcgatctcctgcagctggtgcaccacctcggcgatggacagccgctcctccgggttcacctgcagcatggcgaggatgaggctgtggaagaccgtgtactgcgtgtcgtgcggggggatcgagtacttcccattgactattcgaagtttcgctccatcctcaaaagggtgctgccggaagcacagcaggtacaagatgcagcccagggcccagatatcctgcttctcgccgatcgggaagttggaatacaagtctatgatttctggtgttctatacattggtgttgtattcctcgtgatctgaaaaaatacaaacatttcaaaggaaaagttgcatcccacaaacagtatt

SEQ ID NO: 2719 - DNA, 406 bp, Homo sapiens
tggtacgcctgcaggtaccggtccggaattcccgggtcgacccacgcgtccgaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacct

SEQ ID NO: 2720 - DNA, 300 bp, Homo sapiens
  misc_feature 66, 71, 259: n = A,T,C or G
aggacatctggaatgtcactggtgcccaggtgtacttgagctgtgaggtcatcggaatcccgacanctgtnctcatctggaacaaggtaaaaaggggtcactatggagttcaaaggacagaacttctgcctggtgaccgggacaacctggccattcagacccggggtggcccagaaaagcatgaagtaactggctgggtgctggtatctcctctaagtaaggaagatgctggagaatatgagtgccatgcatccaattnccaaggacaggcttcagcatcagcaaaaattacagtggttg

SEQ ID NO: 2721 - DNA, 232 bp, Homo sapiens
ttcaaaagcttagagagaataagcttcttggtggtgaaatacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaat

SEQ ID NO: 2722 - DNA, 453 bp, Homo sapiens; identical to SEQ ID NO: 677

SEQ ID NO: 2723 - DNA, 520 bp, Homo sapiens
agatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcctcctccttgttgggcttgcactcctggctatctggaagctgcttgtcaccatccacgaccggagggagtttgcaaagtttcagagcgagcgatccagggcccgctatgaaatggcttcaaatctattatacagaaagcctatctccacgcacactgtggacttcaccttcaacaagttcaacaaatcctacaatgg

SEQ ID NO: 2724 - DNA, 404 bp, Homo sapiens
agatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcctcctccttgttgggcttgcactcctggctatctggaagctgcttgtcaccatccacgaccggagggagtttgcaaagttt

SEQ ID NO: 2725 - DNA, 80 bp, Homo sapiens
atggcttcaaatccattatacagaaagcctatctccacgcacactgtggacttcaccttcaacaagttcaacaaatccta

SEQ ID NO: 2726 - DNA, 607 bp, Homo sapiens
tgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacaact

SEQ ID NO: 2727 - DNA, 583 bp, Homo sapiens
ggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgc

SEQ ID NO: 2728 - DNA, 296 bp, Homo sapiens
tacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaaaaagcaaagaggctaagggaagaacg

SEQ ID NO: 2729 - DNA, 208 bp, Homo sapiens; identical to SEQ ID NO: 813
  misc_feature 97: n = A,T,C or G

SEQ ID NO: 2730 - DNA, 274 bp, Homo sapiens
  misc_feature 133: n = A,T,C or G
gcagcggctggagcggcagatcagccaggatgtcaagctggagccagacatcctgcttcgggccaagcaagatttcctgaagacggacagtgactcggacctacagctctacaaggaacagggtgaggggcanggtgaccggagcctgcgggagcgtgatgtgctggaacgggagtttcagcgggtcaccatctctggggaggagaagtgtggggtgccgttcacagacctgctggatgcagccaagatgtggtgcgggcgtcttcatccggga

SEQ ID NO: 2731 - DNA, 330 bp, Homo sapiens
ggccgccctttttttttttttttttttttgggcccagggggggcccccttgggaaaaacacccgggaaacttcccaaaggggccttgggggaattttttttaaaaaaaaacctttttttaaaaaaaactttgggatttaaattttttttccggccccttttttgggccgggtaccccaatttaaaaaaggggggctttttaaaggttgggaaaaaaaaaaaattgggggggcccaaaaaattggggggcccccaaaaaaaaagcggggtttggaaaaattttgggggggtttggaaatttgggccccaaaacgggggacccctttccccc

SEQ ID NO: 2732 - DNA, 525 bp, Homo sapiens
gaatttggccctcgaggccaagaattcggcacgagggttcacatagcaatttaatcaagtaatggttaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagc

SEQ ID NO: 2733 - DNA, 788 bp, Homo sapiens
  misc_feature 42, 44, 48, 49, 51, 52, 53, 54, 55, 57, 59, 61, 62, 63, 64,68, 69, 70, 71, 73, 74, 75, 76, 77, 79, 80, 83, 87, 89,92, 93, 94, 95, 97, 98, 107, 112, 113, 117, 122, 125, 127,130, 131, 133, 671, 677, 685, 706, 713, 718, 725, 757, 771: n = A,T,C or G
  misc_feature 783: n = A,T,C or G
gttcacatagcaatttaatcaagtaatcattaattagggggngngggnngnnnnngngntnnnngtgnnnngnnnnngnnggngtgngngtnnnngnngggaggtgnggaanngttnttttntgngngannantagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagctgccagtccattcccaggccaggctgtcgctggccatccattcagtcgattcagtcataggcgaatctgttctgcccgaagcttgtggtcaagcaaaaattcagccctgaaaatcagcacatctgttcggtggactaaaccacagttagttcgtcaagcagcaacccctgtggcatgaccgccantgggtncatgcgtntgcactgggagttggccaaanctccggnggtcncggggtnttttttgtgggttttttttttttagtcttgtntttgggtaagtggnttttttttttcnttggg

SEQ ID NO: 2734 - DNA, 156 bp, Homo sapiens; identical to SEQ ID NO: 504

SEQ ID NO: 2735 - DNA, 538 bp, Homo sapiens
tacgactcctatagggaatttggccctcgaggccaagaattcggcacgagggtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacaggga

SEQ ID NO: 2736 - DNA, 232 bp, Homo sapiens
  misc_feature 18, 56, 94, 103, 117, 128, 145, 184, 204, 219: n = A,T,C or G
tggctttgctcgcatcancggcgagaagtcgtcccgccgctcagtggtgggcacgncggcctacctggcacccgaggtcttgctcaaccagggntacaaccgntcgctcgacatgtngtcagtgggcntgatcatgtacgtcagnctcagcggcaccttccctttcaacgaggatgaggacatnaatgaccagatccagaacgncgacttcatgtaccnggccagaccctgg

SEQ ID NO: 2737 - DNA, 420 bp, Homo sapiens
taccggtccggaattcccgggtcgacccacgcgtccggcgtctctgctccaccaaggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaaa

SEQ ID NO: 2738 - DNA, 294 bp, Homo sapiens
  misc_feature 2, 170: n = A,T,C or G
gngtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgnatcccacttggcaagtttgctgaggtagagcacgtggtgaacgccatcctctttctgctgagtgaccgaagtggcatgaccacgggttccactttgccggtggaagggggttctggggctgctg

SEQ ID NO: 2739 - DNA, 55 bp, Homo sapiens
  misc_feature 42: n = A,T,C or G
gtctcggtccatgactctggagatccgagaaggaagaggctntggcctgagaaag

SEQ ID NO: 2740 - DNA, 394 bp, Homo sapiens
  misc_feature 22, 335, 365, 377, 383, 391: n = A,T,C or G
ttttttgttcatttatattttntttaagagctgtgcccagttttatcatctcacaagaatgaagcaagggacaaaggtaagtgccacgctccctggccactgggttcctggcaagctcccagccactaggtgccaatctcccttcaatgtactccttcttccccagagtgcagaagcgtatgaagacagttatgacatggacacatgcatgagctattatacataattacaaaagctgattctgtcatcaccacatcttgtctcatcagtaggagcgaatggctggcgggacggtggcacagtcagccttgttcaaagttttgtcgatcacgggncctatattccagagtgacctttcccagtgnccaacgttccanataggncagggtcntgc

SEQ ID NO: 2741 - DNA, 468 bp, Homo sapiens
agctcgggattcggctcgaggacctggaaattccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcacccccagcagcgaggatgac

SEQ ID NO: 2742 - DNA, 254 bp, Homo sapiens
  misc_feature 48, 85, 97: n = A,T,C or G
gacctggagaagttccaggtggtgagctgcatcgaaggggagcctggncccgtcaggagcgtcctcttcaacccagacggctgcngcctgtacagcngctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtgga

SEQ ID NO: 2743 - DNA, 419 bp, Homo sapiens
gacccacgcgtccgtcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggct

SEQ ID NO: 2744 - DNA, 228 bp, Homo sapiens
  misc_feature 190: n = A,T,C or G
gaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgcactcntcgacggagtcctccccgcagggcagccccgagcccct

SEQ ID NO: 2745 - DNA, 525 bp, Homo sapiens
aaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagc

SEQ ID NO: 2746 - DNA, 552 bp, Homo sapiens
tggaaggaactggtctgctcacacttgctggcttgcgcatcaggactggctttatctcctgactcacggtgcaaaggtgcactctgcgaacgttaagtccgtcccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgacttgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtgg

SEQ ID NO: 2747 - DNA, 519 bp, Homo sapiens
tggaaggaactggtctgctcacacttgctggcttgcgcatcaggactggctttatctcctgactcacggtgcaaaggtgcactctgcgaacgttaagtccgtcccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgacttgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcg

SEQ ID NO: 2748 - DNA, 296 bp, Homo sapiens; identical to SEQ ID NO: 1614
  misc_feature 64, 187, 195: n = A,T,C or G

SEQ ID NO: 2749 - DNA, 273 bp, Homo sapiens
cttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaa

SEQ ID NO: 2750 - DNA, 386 bp, Homo sapiens; identical to SEQ ID NO: 399

SEQ ID NO: 2751 - DNA, 239 bp, Homo sapiens
ttttttttttcaaaaaagtcatggaggccatggggttggcttgaaaccagctttggggggttcgattccttccttttttgcctaaattttatgtatacgggttcttcaaatgtgtggtagggtggggggcatccatatagtcactccaggtttatggagggttcttctactattaggacttttcgcttcaaagcgaaggcttctcaaatcatgaaaattattaatattactgctgttaa

SEQ ID NO: 2752 - DNA, 623 bp, Homo sapiens
aaaaagtcatggaggccatggggttggcttgaaaccagctttggggggttcgattccttccttttttgtctagattttatgtatacgggttcttcgaatgtgtggtagggtggggggcatccatatagtcactccaggtttatggagggttcttctactattaggacttttcgcttcgaagcgaaggcttctcaaatcatgaaaattattaatattactgctgttagagaaatgaatgagcctacagatgataggatgtttcatgtggtgtatgcatcggggtagtccgagtaacgtcggggcattccggataggccgagaaagtgttgtgggaagaaagttagatttacgccgatgaatatgatagtgaaatggattttggcgtaggtttggtctagggtgtagcctgagaataggggaaatcagtgaatgaagcctcctatgatggcaaatacagctcctattgataggacatagtggaagtgagctacaacgtagtacgtgtcgtgtagtacgatgtctagtgatgagtttgctaatacaatgccagtcaggccacctacggtgaaaagaaagatgaatcctagggctcagagcactgcagcagatcatttcatattgct

SEQ ID NO: 2753 - DNA, 265 bp, Homo sapiens
ggcttagcggataacaatttcacacaggagttgcaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagct

SEQ ID NO: 2754 - DNA, 625 bp, Homo sapiens
aatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaag

SEQ ID NO: 2755 - DNA, 253 bp, Homo sapiens
ggcttgtaatacgactcactatagggctttttttttttcaaaaaagtcatggaggccatggggttggcttgaaaccagctttggggggttcgattccttccttttttgtctaaattttatgtatacgggttcttcaaatgtgtggtagggtggggggcatccatatagtcactccaggtttatggagggttcttctactattaggacttttcgcttcaaagcgaaggcttctcaaatcatgaaaattattaat

SEQ ID NO: 2756 - DNA, 290 bp, Homo sapiens
caaactcatcactagacatcgtactacacgacacgtactacgttgtagctcacttccactatgtcctatcaataggagctgtatttgccatcataggaggcgtcattcactgatttcccctattctcaggctacaccctagaccaaacctacgccaaaatccatttcactatcatattcatcggcgtaaatctaactttcttcccacaacactttctcggcctatccggaatgccccgacgttattcggactaccccgatgcatacaccacatgaaacatcctatcatct

SEQ ID NO: 2757 - DNA, 638 bp, Homo sapiens
  misc_feature 522, 634, 636: n = A,T,C or G
atatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttattcggactaccccgatgcatacaccacatgaaacatcctatcatctgtaggctcattcatttctctaacagcagtnatattaataattttcatgatttgagaagccttcgcttcgaagcgaaaagtcctaatagtagaagaacccttcataaacctggagtgactatatggatgccccccaccctacnanca

SEQ ID NO: 2758 - DNA, 531 bp, Homo sapiens
ggcttagcggataacaatttcacacaggagttgcaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatct

SEQ ID NO: 2759 - DNA, 625 bp, Homo sapiens
atatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagtcttcgcttcgaagcgaaaagtcctaatagtagaagaacccttcataaacctggagtgactatatggatgccccc

SEQ ID NO: 2760 - DNA, 217 bp, Homo sapiens
tttttttttttaaaaagtcatggaggccatggggttggcttgaaaccacctttggggggttcaatcccttccttctttgtctaaattttatgtatacgggttcttcaaatgtgtggtaggggggggggcatccatatagcccctccaggtttatggagggttcttctactattagaacttttcccttcaaagcaaaggcttctcaaatcatgaaaat

SEQ ID NO: 2761 - DNA, 636 bp, Homo sapiens
  misc_feature 496, 562, 564, 605, 635: n = A,T,C or G
aaagtcatggaggccatggggttggcttgaaaccagctttggggggttcgattccttccttctttgtctagattttatgtatacgggttcttcgaatgtgtggtagggtggggggcatccatatagtcactccaggtttatggagggttcttctactattaggacttttcgcttcgaagcgaaggcttctcaaatcatgaaaattattaatattactgctgttagagaaatgaatgagcctacagatgataggatgtttcatgtggtgtatgcatcggggtagtccgagtaacgtcggggcattccggataggccgagaaagtgttgtgggaagaaagttagatttacgccgatgaatatgatagtgaaatggattttggcgtaggtttggtctagggtgtagcctgagaataggggaaatcagtgaatgaagcctcctatgatggcaaatacagctcctattgataggacatagtggaagtgagctacaacgtantacgtgtcgtgtagtacgatgtctagtgatgagtttgctaatacaatgccagtcaggccacctacngngaaaaagaaagatgaatcctagggctcaaaacacctgcacnagatcatttcatattggcttccgtggagtnc

SEQ ID NO: 2762 - DNA, 279 bp, Homo sapiens
ggcttagcggataacaatttcacacaggagttgcaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcat

SEQ ID NO: 2763 - DNA, 623 bp, Homo sapiens
  misc_feature 537: n = A,T,C or G
aatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctncataaacctggagtgactatatggatgccccccaccctaccacacattcgaagaacccgtatacataaaatctagacaaaaaagga

SEQ ID NO: 2764 - DNA, 189 bp, Homo sapiens
  misc_feature 170, 173: n = A,T,C or G
tggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagnctntcagcatccatggcta

SEQ ID NO: 2765 - DNA, 507 bp, Homo sapiens; identical to SEQ ID NO: 645

SEQ ID NO: 2766 - DNA, 193 bp, Homo sapiens
ttttttttttttttttttttttttttggccgagactccaagactattatttttatttccggacaaaaacatctgcttcacacagtgcacggcatcaaatgaagaggaaagaacttgtatcccaaagcctggctttctgtatcatccacaaattaagacagcatctgctgagcccatgctgagcctgtcacagt

SEQ ID NO: 2767 - DNA, 235 bp, Homo sapiens
  misc_feature 183, 184, 185, 193: n = A,T,C or G
cccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctnnncccctacnacccccctgagggccccagacccctctccaggtggggttcca

SEQ ID NO: 2768 - DNA, 493 bp, Homo sapiens
agaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgtccccggcataggtccatctctgcagaagccatttcaggagtacctggaggctcaacggcagaagcttcaccacaaaagcgaaatgggcacaccacagggagaaaactgcttgtcctggatgtttgaaaagtcggtcgatgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttatattgggaggactccaagccgggaaggaaaattccctttt

SEQ ID NO: 2769 - DNA, 345 bp, Homo sapiens
agaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgtccccggcataggtccatctctgcagaagccatttcaggagtacctggaggctcaacggcagaagcttcaccacaaaagcgaaatgggcacaccacagggagaaaactggttgtcctggatgtttgaaaagtcggtcgttgtcatggtgtgttacttcatcctatctatcattaactccatggt

SEQ ID NO: 2770 - DNA, 374 bp, Homo sapiens
tagaagagctaacctcacactcatcccactctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcag

SEQ ID NO: 2771 - DNA, 360 bp, Homo sapiens
tttttttttttttttttttgtgcggtgggaattctctaattgtatcatgtgggccttttgaaagtaacaaacagaaggccagtctgctgcaagtttgctgctgaacatcacattccaccctaagaaaacacaaggtggattgcatcgagggtggataccttaccttagcacggaaggaaaaagtatgtcagtgcaaagtatggactaaactgctttcaggaaaaaagttgtaaaaattgatacaggttggaaaagggaattttccttcccggcttggagtcctcccaatttaaggcagaacccatccactccaatttctgcagtttaaaactttctctacttatttagttttctcctctg

SEQ ID NO: 2772 - DNA, 247 bp, Homo sapiens
ctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcatgaacaggga

SEQ ID NO: 2773 - DNA, 350 bp, Homo sapiens
taatggatttgtttggagatggcatgttggtagacgactgaatatggaaaggatatcaagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataatttttttttttttttggaaacgggtttttgttttggcccagcccaaaaacatcccttggttaccccttccggggaaaaaaaaccaaacccctttttcggggaaaaaaaaaggg

SEQ ID NO: 2774 - DNA, 455 bp, Homo sapiens; identical to SEQ ID NO: 530
  misc_feature 81, 195, 231, 247, 298, 307, 317, 395, 427, 446, 451: n = A,T,C or G

SEQ ID NO: 2775 - DNA, 444 bp, Homo sapiens
  misc_feature 17, 20, 391, 430: n = A,T,C or G
ttttctgacgtctgttnctnaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtttgtgttgagtttaaaaccatagcagttttgctctggcaagtaatggaaagcgttctcgcttcctgagtntgagctccagcagactgcagagtggccagtgccacagtngtagcctgactttc

SEQ ID NO: 2776 - DNA, 502 bp, Homo sapiens
ggttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaaggtgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcag

SEQ ID NO: 2777 - DNA, 377 bp, Homo sapiens
ggttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaaggtgaaatcccagagactgtctcgttggagatgcttgatgctgcaaagaacaagatgcgagtgaagatcagctatctaatgattgccctgacggtggtaggaa

SEQ ID NO: 2778 - DNA, 552 bp, Homo sapiens; identical to SEQ ID NO: 753

SEQ ID NO: 2779 - DNA, 186 bp, Homo sapiens
ctgctcagcctggtgaacacacagcccgatttacccagtccccactccaggtgcagctgcggcttatctctcagcccagcgagatgccagccttcctgtcccgggccagcgctctgacatgcagaaggtgaccctgggcctgcttgtgttcctggcaggctttcctgtcctggacgccaatgacct

SEQ ID NO: 2780 - DNA, 121 bp, Homo sapiens
tctgctcagcctggtgaaccacacaggcccgagtttcacccagtccccactccacggtgcagctgcggcttatctctcagcccagcgagatgccagccttcctgtcccgggccagcgctct

SEQ ID NO: 2781 - DNA, 336 bp, Homo sapiens
  misc_feature 336: n = A,T,C or G
agggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgn

SEQ ID NO: 2782 - DNA, 460 bp, Homo sapiens
tgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgaaaaaaaaaaaaaaaaaaaaaaaaaaaaaaaattttttgggg

SEQ ID NO: 2783 - DNA, 432 bp, Homo sapiens
  misc_feature 46, 151, 350, 362, 383, 403, 417: n = A,T,C or G
ggggttgcagacggaggtcaggtcttcctctttcctgagactgganctgttcaaacagcaaacgcccacagatggcccagaggtggtggtagtcagggtgtgtgggtgtttttagggttctttagtgttgtttctttcacccaggggtggntggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcanttaatgggccanttaactgagaatgtaagaaantgatgctgttacaaggcaantaaagccgttttanttaaccctgaaaaaa

SEQ ID NO: 2784 - DNA, 467 bp, Homo sapiens
acgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacacgggcatcgccttcaaggttgctgatcccacaccctttcatattcaagctgaagtgacgatgaaaacaaatttctctggtacccgagatgtgtgcacagaattactccctctaataaaaccccaagggagagtggtgaacgtacctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatac

SEQ ID NO: 2785 - DNA, 626 bp, Homo sapiens
tacggccgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacacgggcatcgccttcaaggttgctgatcccacaccctttcatattcaagctgaagtgacgatgaaaacaaatttctctggtacccgagatgtgtgcacagaattactccctctaataaaaccccaagggagagtggtgaacgtacctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagccc

SEQ ID NO: 2786 - DNA, 487 bp, Homo sapiens
tggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgccctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaat

SEQ ID NO: 2787 - DNA, 345 bp, Homo sapiens
tggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgccctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagca

SEQ ID NO: 2788 - DNA, 495 bp, Homo sapiens
cggccgcccttttttttttttttttttttttttttttttttttttttttttttttttttttttttttttcaaaaaaaaatttttttgggtttttttttttaaaactttttttttttttttttttggggggggccaaattcccccccaaaaaaaaaaaaaaaggggggggtttcccccccccccctttttttttttgggggggtttttttttttggggggggccccccccccctttttttttttttggaaaaaaatcccccccttggggggggtttctttttcccaaagggagttttttttcccccccccccgggggggggggggggtttttttttttttaaaaaaaaaacccccggaaaaaaaaaaacccccccccccccccccccccccaaaaaaaaaaaaggggggaaaaatgggggccccccctttttttttttttttttttttggggggggggaaaaaaaaccccccccccctttttgggggggttttttt

SEQ ID NO: 2789 - DNA, 503 bp, Homo sapiens
attccgttgctgtcgagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggc

SEQ ID NO: 2790 - DNA, 581 bp, Homo sapiens
agtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatct

SEQ ID NO: 2791 - DNA, 598 bp, Homo sapiens; identical to SEQ ID NO: 1213

SEQ ID NO: 2792 - DNA, 316 bp, Homo sapiens
ctgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaa

SEQ ID NO: 2793 - DNA, 275 bp, Homo sapiens
atgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtag

SEQ ID NO: 2794 - DNA, 522 bp, Homo sapiens
cagaagggaacaccagagctttgctaataattagtgtggtcaagagccgtctgagcctaatgagtcccagctgcattaggttaagagactcttccagagccatcgccaggtcgggaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccagttgtcagaaggatgtatgatgaccccctcccctcccatccttcacctcctaagcagtcctggcttttcctcatcactcccctctacagt

SEQ ID NO: 2795 - DNA, 331 bp, Homo sapiens
aacaccagagctttgctaataattagtgtggtcaagagccgtctgagcctaatgagtcccagctgcattaggttaagagactcttccagagccatcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctg

SEQ ID NO: 2796 - DNA, 228 bp, Homo sapiens
gagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtc

SEQ ID NO: 2797 - DNA, 342 bp, Homo sapiens; identical to SEQ ID NO: 1001

SEQ ID NO: 2798 - DNA, 311 bp, Homo sapiens
ggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcacagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataagg

SEQ ID NO: 2799 - DNA, 402 bp, Homo sapiens; identical to SEQ ID NO: 996

SEQ ID NO: 2800 - DNA, 232 bp, Homo sapiens
ttccatctcgagggactataacctgaacgacgacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgc

SEQ ID NO: 2801 - DNA, 435 bp, Homo sapiens
tgactctgacttctgaggaagaggcccgtttgaagaagagtgcacatcactttgggggatccaaaaggagctgcaattttaaagtcttctgatgtcatatcatttcactgtctaggctacaacaggattctaggtggaggttgtgcatgttgtcctttttatctgatctgcgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttactggctccttcactgaacatgccta

SEQ ID NO: 2802 - DNA, 309 bp, Homo sapiens
atcatttcactgtctaggctacaacaggattctaaggggacgttgtgcatgttggcctttgtatctgatctgtgattaaagcagtaatattttaagatggactgggaaaaacatcaactcctgaagttagaaataagaatggtttgtaaaatccacagctgtatgctgaagctggatggtattaatcttgcgtagtcttcaactggttaggtgaaatagttctgccacctctgacgcaccactgccaatgctgtacgtactggatttggcccttgagccaggtggatgttcaccgggcgtgatataact

SEQ ID NO: 2803 - DNA, 342 bp, Homo sapiens
  misc_feature 342: n = A,T,C or G
atcatttgactgtctaggctacaacaggattctaggtggaggttgtgcatgttgtcctttttatctgatctgtgattaaagcagtaatattttaacatggactgggaaaaacatcaactcctgaagttagaaataagaatggtttgtaaaatccacagctatatcctgatgctggatggtattaatcttgtgtagtcttcaactggttagttgaaatagttctgccacctctgacgcaccactgccaatgctgtacgtactgcatttgccccttgagccaggtggatgtttaccgtgtgttatataacttcctggctccttcactgaacatgcctagtccan

SEQ ID NO: 2804 - DNA, 266 bp, Homo sapiens
gggacagaatggctatctcggaccttgtgaaggtgactctgacttctgaggaagacgcccgcttgaagaagagagcccatacactttgggggatccaaaacgagctgcgattttcaagtcttctgatgtcatatcattccactgtctaggctacaacaggattctagggggacgttgtgcatgttggcctttttatctgatctgtgactaaagcactaatattttaagatggactgggaaaaacatcaactcctgaagttagaaat

SEQ ID NO: 2805 - DNA, 383 bp, Homo sapiens
ggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgacctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgct

SEQ ID NO: 2806 - DNA, 453 bp, Homo sapiens
aaccgcttctccgttgaacaacatactagatggggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgt

SEQ ID NO: 2807 - DNA, 383 bp, Homo sapiens; identical to SEQ ID NO: 2805

SEQ ID NO: 2808 - DNA, 97 bp, Homo sapiens
gttgccttggagatgatcaaagtaactggtggctatccatttgaagcttacaaaaattgttttcttaacttagccattccaattgtagtatttacag

SEQ ID NO: 2809 - DNA, 442 bp, Homo sapiens
gccctagttattataccatattacatcattactctatgtaattatctatgaagctatgtagttatttacccctgtattaagtgattttagactgttgttattttttgagttacagcatgtgctttcaaaatagggagactgtatggttgaattaatatttttttaaataactgttaacatgtatagagtaggttgaaagtttgaaagtataaaatatactaaaagtatacagacctgtaataagaaatttatattactatagtcccatagctgcttttactatccacagagaaatgcttgaaaacgtgaaagttgaatagatgcaattaaaatcacggatagttttaggctgtttatattatcagatcaccttcttttatctaggttgccttggagatgatcaaagtaactggtggctatccatttgaagcttacaaaaatt

SEQ ID NO: 2810 - DNA, 380 bp, Homo sapiens
gagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagggctgatggatttgaggttacctccagaagggagg

SEQ ID NO: 2811 - DNA, 133 bp, Homo sapiens
ccagtactgcctcctgtgctcgtgccaagacacagtgaatataacccccagctcagcctcctggccaagttccgcagcgcctccctgcacagtgagccactcatgccacacaacgccacctatcctgactctt

SEQ ID NO: 2812 - DNA, 428 bp, Homo sapiens
tccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagcccccactggtgctcggtcgcctactatgaactgaacaaccgagttggggagacattccaggcttcctcccgaagtgtgctcatagatgggttcaccgacccttcaaataacaggaacagattctgtcttggacttctt

SEQ ID NO: 2813 - DNA, 497 bp, Homo sapiens
cggctgcgagaagacgacagaaggggggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaaatctgatactccatttgatta

SEQ ID NO: 2814 - DNA, 356 bp, Homo sapiens
gggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttaaggccttgtaaggctgtttccttttgcatctggaactgactatat

SEQ ID NO: 2815 - DNA, 348 bp, Homo sapiens
gggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaact

SEQ ID NO: 2816 - DNA, 337 bp, Homo sapiens
aagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgct

SEQ ID NO: 2817 - DNA, 252 bp, Homo sapiens; identical to SEQ ID NO: 790
  misc_feature 144: n = A,T,C or G

SEQ ID NO: 2818 - DNA, 51 bp, Homo sapiens
actcccagctgcactggttacacgtcttccttcgtcttcacctaccccgag

SEQ ID NO: 2819 - DNA, 348 bp, Homo sapiens; identical to SEQ ID NO: 1049

SEQ ID NO: 2820 - DNA, 507 bp, Homo sapiens; identical to SEQ ID NO: 419

SEQ ID NO: 2821 - DNA, 239 bp, Homo sapiens
  misc_feature 223: n = A,T,C or G
agactccaagccctactgggaggcacggagggtggcgaggcaggctcagctggaagctcagaaagccacgcaggacttccagagggccacagaggtgctccgcgccgccaaggagaccatctccctggccgagcagcggctgctggaggatgacaagcggcagttcgactccgcctggcaggagatgctgaatcacgccactcagagggtcatggaggcgganagaccaagaccaggag

SEQ ID NO: 2822 - DNA, 313 bp, Homo sapiens
catcagtgatagggatgattcacaaacacaaagctggtcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgggaaccacaagatggagtcattaaaataaaggcatcatctctttcaacggataaaatagccgaacaagattttttcttatttcttccctgatgattccacccc

SEQ ID NO: 2823 - DNA, 574 bp, Homo sapiens
aaataacatcaacagaacagcttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttc

SEQ ID NO: 2824 - DNA, 518 bp, Homo sapiens
gaagggaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttt

SEQ ID NO: 2825 - DNA, 353 bp, Homo sapiens
aaataacatcaacagaacaacttcactttgggccaaacatttaaaaaactttttataaaaaaatgtttgatatttcttaatgtctgctctgagccttacaacacagattgaagaagaaaagaaagaacaaacttagatatttatttctatgctttgttgcctctgagaataatgacaatttatgaatttgagtttcaaattgataaaatatttaggtactaataacaagactaataatattttcttatttataaaaagcatgggaagatttttatttatcaaaatatacaggaagtgtagacaaaatggatataaatgaaaattaccatgttgtaaaaccttgaaaatcagag

SEQ ID NO: 2826 - DNA, 401 bp, Homo sapiens
gacctgcacacagagactccctcctgggctcctggcaccatggccccctgaagagctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccggtggtgttcaccgcccccaccct

SEQ ID NO: 2827 - DNA, 547 bp, Homo sapiens
gacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggaggccttccagggacgaagaagagccacagtgagggagatcccatccccttgtctgaactggagccatgggcacaaagggcccagattaaagtctttatcctcaaaaaaaaaaaaaaaaaaaaaa

SEQ ID NO: 2828 - DNA, 283 bp, Homo sapiens
ctgagcagagggacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaa

SEQ ID NO: 2829 - DNA, 160 bp, Homo sapiens; identical to SEQ ID NO: 12

SEQ ID NO: 2830 - DNA, 300 bp, Homo sapiens
tttttttttggggccaattctttaatttaactaaattaggaacgcagcttttacagaacaataaacacaagggacggggccaccccaggatctaacagcttttcagggacctatgttgcaagctcaaaagtaatccactaacgaaccaagtcaaactccagtttttaataaaaaggggctgggggaggttgtcaaaccccttccaatataaatccccaatccgagggccaccaaatgaaaaagcaccaaaaatggaaggaaaactttcaaaaattctgcaaaaaatatgccccctttttt

SEQ ID NO: 2831 - DNA, 394 bp, Homo sapiens
gtctattcttttattttactaaattaggaacgcagcatttacagaacaataaacacaagtgacgtggccaccccaggatctaacagctcttcagtgagctatgttgcaagctcagaagtaatccactaacgaaccaagtcagactccagttcttcatcaaaaggtgctggtggaggttgtcagacgccttccaatatagatccccaatccgatggccagcaaatgagagagcagcagagatggaaggaaaacttccagaaattctgcagagaatatgccccctttcttcatgacgctcgtgttcccccatgctgaaggtggccgtgcgcttccggtgtttaaagaagaacccttggggggaatatttcccggccatttgaccaatcccattcca

SEQ ID NO: 2832 - DNA, 524 bp, Homo sapiens
gtctattcttttattttactaaattaggaacgcagcatttacagaacaaataaacacaagtgacgtggccaccccaggatctaacagctcttcagtgagctatgttgcaagctcagaagtaatccactaacgaaccaagtcagactccagttcttcatcaaaaggtgctggtggaggttgtcagacgccttccaatatagatccccaatccgatggccagcaaatgagagagcagcagagatggaaggaaaactttcagaaattctgcagagaatatgccccctttcttcatgacgctcgtgttcctcatgctgaggtggccgtgcgcttccggtgtttaaagaagaacccttggggggaatatttccggccgacttgaccaatcccatatccatctgatttttcttccagaagctttcacttccttcctccttcaatatcactccctcaactgtgactgttttccccccaatgctatggtttctgttcaaaaccccgttggttctgttgggtcgctactccgt

SEQ ID NO: 2833 - DNA, 55 bp, Homo sapiens
ggccgcccttttttttttttttttttcgggggcgttttttgatttttaaaattgg

SEQ ID NO: 2834 - DNA, 463 bp, Homo sapiens
tcactatagggaaagctggtacgcctgcaggtaccggtccggaattcccgggtcgacccacgcgtccgccgcccccgagacctgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctgg

SEQ ID NO: 2835 - DNA, 274 bp, Homo sapiens
  misc_feature 144, 218, 268: n = A,T,C or G
ccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcangcaagagagaggattcagacgctctgggagccagttcctagtcctcaactccagccacctgccccagctcgacngcactgggccagttccccctctgctctgcagtcggtttccttttctagantggaaa

SEQ ID NO: 2836 - DNA, 232 bp, Homo sapiens
cggctgtgagaatacgacagaagggtccggctgcgagaagacgacagaagggggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtggggg

SEQ ID NO: 2837 - DNA, 321 bp, Homo sapiens; identical to SEQ ID NO: 1067

SEQ ID NO: 2838 - DNA, 344 bp, Homo sapiens
  misc_feature 265, 267, 272, 337: n = A,T,C or G
gtcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagngnggttntcccgtgcatcttcagcctggcacattatggacacttaaatactacgtattgatctaatattgangggttaa

SEQ ID NO: 2839 - DNA, 405 bp, Homo sapiens
ggcacgagggatgaagggtgctgctcattttcattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggggttcccctcttaaaggagaggagcttttaatttacacttaccacctcatttgcttttttggaggccatgccatataagcgggactaccgagttaatctcctttttacaaaag

SEQ ID NO: 2840 - DNA, 227 bp, Homo sapiens
ggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttg

SEQ ID NO: 2841 - DNA, 521 bp, Homo sapiens
tcgaattcggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatg

SEQ ID NO: 2842 - DNA, 325 bp, Homo sapiens
ggactttcccgatcgccaggcaggagtttctctcggtgactactatcgctgtcatgtctggtcgtggcaagcaaggaggcaaggcccgcgccaaggccaagtcgcgctcgtcccgcgcgggccttcagttcccggtagggcgagtgcatcgcttgctgcgcaaaggcaactacgcggagcgagtgggggccggcgcgcccgtctacatggctgcgttcctcgagtatctgaccgctgagatcctggagctggcgggcaacgcggctcgggacaacaagaagacgcgcatcatccctcgtcacctccagctggccatccgcaacga

SEQ ID NO: 2843 - DNA, 401 bp, Homo sapiens
  misc_feature 264: n = A,T,C or G
cgttgctgtcggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgntctaaccctccctggcatgtcacaaccaggctctggctggaggatccctccatccggctcctgtcatcccctacactttggcctagcaagaggtggaataaccacttgtgtgctcattactgttgggaggaacaaag

SEQ ID NO: 2844 - DNA, 460 bp, Homo sapiens
catgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagaaccaggctctgcctggaggatccctccatccggctcctgtcatcccctacactttggccaagcaagaagtggtagaaccacttggctgctccttccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccact

SEQ ID NO: 2845 - DNA, 496 bp, Homo sapiens
tttttttttttttttttttttttttgggattcttaaatatagatgtatttttttcatctcatctccggacacactccaatcacacccctcctgccctcccctctcaactgcaaaccaagcggtgcagacacagcacagcacacatgaggggccctccctttcaccaaagctgaaggcagggcacagtttggggatggaagagcctcgaggtaaatgtgggggttctagaacccagtgacctcagttctggatcatgggaaagggatcagtatgcagtaacgtggtaaggttccagatctagaagccaggacctagaacctagtggtttcacagtgggcagagcagttgggaataagccaggttaggggtgggggaagacagccagctctgtcctctgcaggcggattccctggagggagatctcagatttagaaaggaagagtaggatctggtccagaaagggccagaaagacaggaaggcatctggactgagact

SEQ ID NO: 2846 - DNA, 283 bp, Homo sapiens
ttttttttttttttttttttttttttttaggatttgaatacatttattgtgacaagaatgctgttataaatattcataagcaaaggccatctttttatctaggaattgtcaaagagaagattccaaattggaaggatacatcttttgtaaaatctgccaccaattcctgctttgagaataagcacctattgtaaaatttctactaacattataaatggtcacagcacatgccacttgatacaatccaaactttgaaatgtttgacttctcagtgggctgtccc

SEQ ID NO: 2847 - DNA, 335 bp, Homo sapiens
tgtcgggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacc

SEQ ID NO: 2848 - DNA, 75 bp, Homo sapiens
gggtagagttcttaaatcgagatctggaggtagatggacgctttgtaaccctccagatctgggacactgcagggc

SEQ ID NO: 2849 - DNA, 611 bp, Homo sapiens
gccggggggcagcggcgggcgcgagcggcagctgtcaggccaccgaggtccaagccgcacttgctgccccattgaggacgaggaggcagcaggagcagtgacggtgactctaaggagccggattcccggcacgcagagctgacctgcctggcacccgcggccctctcctgtttccttcccattgtgttggcaccctaaaaagaaagaataaaacaacaacaggaaaaaaaggaaaatatttaaattgtgacaaaaacccactgggttctcttggttacaaactccttcccttctggtgctacaaaaatgagtgggaaatccctgctcttaaaggtcattctcttgggtgatggtggagttgggaaaagttcgcttatgaaccgttacgtaaccaacaaatttgactcccaggcttttcacaccataggggtagagttcttaaatcgagatctggaggtagatggacgctttgtaaccctccagatctgggacactgcagggcaggaacgtttcaagagccttaggacacccttctacaggggagcagactgctgcctcttgaccttcagcgtggatgatcggcagagcttcgagaatcttggtaactggca

SEQ ID NO: 2850 - DNA, 441 bp, Homo sapiens
ggcctttgcaagcctcaccggcgatgcaaggatagtcatcaacagggcccgggtggagtgccagagccaccggctgactgtggaggacccggtcactgtggagtacatcacccgctacatcgccagtctgaagcagcgttatacgcatagcactgggcgcaggcgtttggcatctctgccctcatcgtgggtttctactttgatggcactcctaggctctatcagactgacccctctgtcacataccatgcctggaaggccaatgccatacgccggggtgccaactcagtgcgtgagttcctggagaagaactatactgacgaagccattgtaacatatgatctgaccattaagctggtgatcaacgcactcctggaagtggttcactcaggtggcaaaaacattgaacttgctgtcatgaggcgagatcaatccctcaag

SEQ ID NO: 2851 - DNA, 323 bp, Homo sapiens
ggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcacagcaatgggcgcaggcgtttggcatctctgccctcatcgtgggtttcgactttgatggcactcctaggctctatcagactgacccctcgggcacataccatgcctggaaggccaatgccatatgccggggtgccaagtcagtgcgtgagttcctggagaagaactatactgacga

SEQ ID NO: 2852 - DNA, 567 bp, Homo sapiens; identical to SEQ ID NO: 603

SEQ ID NO: 2853 - DNA, 314 bp, Homo sapiens
  misc_feature 48: n = A,T,C or G
atgaagtccagcggcctcttccccttcctggtgctgcttgccctgggnactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctg

SEQ ID NO: 2854 - DNA, 611 bp, Homo sapiens
ggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtcc

SEQ ID NO: 2855 - DNA, 370 bp, Homo sapiens
tggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtca

SEQ ID NO: 2856 - DNA, 177 bp, Homo sapiens
gggctgcatcaccatcataggtggtggagacactgccacttgctgtgccaaatggaacacggaggataaagtcagccatgtgagcactgggggtggtgccagtttggagctcctggaagggaaagtccttcctggggtggatgctctcagcaatatttagtactttcctgcctttta

SEQ ID NO: 2857 - DNA, 204 bp, Homo sapiens
  misc_feature 53, 55, 76, 86, 137: n = A,T,C or G
atggcttttaccttccttaaggtgctcaacaacatggagattgggcactttcncnggttgatgaagaaggaagccnagatttgtcnaagacctaatgtccaaaagctgagaagaatggtgtgaagattaccttgccntgttgacttgtcactgctgacaagtttgatgagaatgcccaagactggcccagccactggtggcttc

SEQ ID NO: 2858 - DNA, 489 bp, Homo sapiens
cttttaccttccttaaggtgctcaggacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctgga

SEQ ID NO: 2859 - DNA, 885 bp, Homo sapiens; identical to SEQ ID NO: 281

SEQ ID NO: 2860 - DNA, 434 bp, Homo sapiens
cggctgcgagaagacgacagaaggggggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtatt

SEQ ID NO: 2861 - DNA, 318 bp, Homo sapiens
gggagtgggtgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgcttcttctcttctgtgttgcgatttttgatcaattctttaattttggaagcctataat

SEQ ID NO: 2862 - DNA, 231 bp, Homo sapiens
cggctgcgagaagacaacagaagggggctcccgctcgggatctcgctccggatctcgctccgggtcccgcagtgggtcccggagaggaagctttgacgccacaaggaattcttcctactcttattcctactcatttagcagtagttctattgggcactattagtcagttgggagtgggtgctataccttgacttcatttatatgaatttccactttattaaataatagaaa

SEQ ID NO: 2863 - DNA, 446 bp, Homo sapiens
atttgctgtatgccgagaatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatc

SEQ ID NO: 2864 - DNA, 209 bp, Homo sapiens
  misc_feature 19, 185, 193: n = A,T,C or G
gagaatttgctgtatgccngagatggaaaaattggaccacctaaactggatatcagaaaggaggagaagcaaatcatgattgacatatttcacccttcaagtttttgtaaatggagacgagcaggaagtcgattatgatcccgaaactacctgttacattagggtgtacaatgtgtatgtgagantgaacggnagtgagatccagtata

SEQ ID NO: 2865 - DNA, 521 bp, Homo sapiens
tgctgtcggtgactactgaagaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaac

SEQ ID NO: 2866 - DNA, 522 bp, Homo sapiens
tggccctcgaggccaagaattcggcactaggggagaggagcttgaatttctgacacacataacatgtaaaaagtatttggcatttcataaggatttggggtggggtaaacgcaaggttagtctgttttaaaaaatgttttcattaacgagcacataactggtggttcctaatgggaatacttgacccaggcagaaactagaaaagtagcaagtaggaaacttccatttctctcccctaaacaaccccttaaggcactgtgagctggagacaggagaggtgttgcccaacctttgttcatatactcggtgacgatgtagatgggctcctcagacaccactgcatagagctggaccagcttgtcgtgcttcagcttcttcatgatctgcgcttcctcaaggaatgattcgggggacattgtgcctggtttaagagtctttatggctacttttgtgtttccattccaggtacctacaaacatcccagaatatgaagtcaaaccaaagatcttcttttgatggaaa

SEQ ID NO: 2867 - DNA, 421 bp, Homo sapiens
  misc_feature 12, 331, 372: n = A,T,C or G
ttaatgagttanaaatcttaatatagccatcttagccataaccacaaataaactcattttttctgttaaaatacttgacagagtccttgcaattgaatgtctttgttcaacaaaaactgtattaagtgttttaaatttaaaatctaatcttatgcaaatagctggtggtcaaaacctttttccatcaaaagaagatctttggtttgacttcatattctgggatgtttgtaggtacctggaatggaaacacaaaagtagccataaagactcttaaaccaggcacaatgtcccccgaatcattccttgaggaagcgcagatcatgaagaagcngaagcacgacaagctggtccagctctatggcagtggtgtcngaggagcccatctacatcgtcaccgagtatatgaacaaaggttgggcaa

SEQ ID NO: 2868 - DNA, 503 bp, Homo sapiens
cagaaggggtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctgtcgcagtgtttcagttctttattttcccttgtggatatgctgtgtgaaccgtcgtgtgagtgtggtatgcctgatcacagatggattttgttataagcatcaatgtgacacttgcaggacactacaacgtgggaca

SEQ ID NO: 2869 - DNA, 365 bp, Homo sapiens
ggccgcccttttttttttttttgggggggaaaaaatttttttttaaaaaaaaaaaaacttcccccctggggaaaaaaaaaggttttttaaaaaaaaaaccaaacaaaattttcccgggccctttaggggttttaaattttcccccgggttgaaccccttttaaaaaaaaaggaatttttttggggggaaataatgggggaaaaaccaaaaaaaaaggggggttttttttttaaaacccttttttttttaaaaaaccttcccccaggggaaaaattcccaaaaccttttaaaaaaaaagggccgaaatttttaatccaaaggggaaaaaccccccccccaacaaaaaacccccaaaggggaaaaag

SEQ ID NO: 2870 - DNA, 680 bp, Homo sapiens
  misc_feature 172, 173, 176, 186, 199, 200, 591, 625, 659, 670: n = A,T,C or G
aggacacagacaaggaacttgctgaaaggccaaccatttcaggatcagtcaaaggcagcaagcagatagactcaaggtgtgtgaaagatgttatacaccaggagctgccacttcatgtcccaaccagactgtgtctgtctgtgtctgcatgtaagagtgagggagggaaggnnggnactacaaganagtcggagatganncagcacacacacaattccccagcccacgtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaattggataaatacacacaccatacactatccacagatatagccaagtagatttgggtagaggatactatttccagaatagtgtttagctcacctagggggatatgttgtatcacatttgcatatnccacatggggacataagctaattttttacagacncgattctgtcatgctgttaatagccatggttaancccccattggnggggccggtg

SEQ ID NO: 2871 - DNA, 570 bp, Homo sapiens
taagctcgggattcggctcgagcggctcgagtcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcag

SEQ ID NO: 2872 - DNA, 454 bp, Homo sapiens
gccgcccttttttttttttttttttttttttttttttttgtttttttttttttttcaaaaaaaaaaaatctttttagaaaaaaaaacccccccccaacaaaaaatggggggggggggggattttccctcccgggggaaggagaaaaagccgcagtaataaaaagggggggaaccaaaaaatttttttttttttttaaaaaaggtttttttgggggcccccccccccaaaaaaaaaaaaggtcccccccctttttttcccccctttttgggggggaaaaaaaaaaaaggggggggaaaaaaacagaaaattttccccaaaaatttaaaaaaaaaaggggggggggggggaaaaaaaaggtttttttacccccctgggggggaaaaaaaaaaaatttggggccaccaaaaaggggggggggccccccaaaaaagggggttttttttaaaaaaaaaa

SEQ ID NO: 2873 - DNA, 651 bp, Homo sapiens
taagctcgggattcggctcgagtggtcttcgtctactccgggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccc

SEQ ID NO: 2874 - DNA, 280 bp, Homo sapiens
  misc_feature 112: n = A,T,C or G
tggtcttcgtctactccagggtctttcaggaggccaaaaggcagctccagaagattgacaaatctgagggccgcttccatgtccagaaccttagccaggtggagcaggatgngcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaagaagtttac

SEQ ID NO: 2875 - DNA, 418 bp, Homo sapiens
ggccgcccttttttttttttttttttcccgggcttttttgggaaaaacccccctttcccataaaaaaatttttttgggggtttcccaatttttttttccaatttcaaataatttttttccaaaaaaaacccaaacccttggggcctttttttttttttttaaagggcctttttacttttccccaaggaggccttggggaaataaaaaaaacccggttggggggccccaaaaaaggggtgggcccccttgaatcccccattggtttgggggtaaaaaaggcccccccatgggcccccttcccccgggggggggaacccccccccaagacccccccgggggaaaccgggcccaaaaaaaaaaccctttaaaattttaaaaaacgggcccccccctaaaaaaacttttttttaaaaagggg

SEQ ID NO: 2876 - DNA, 292 bp, Homo sapiens
ttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaat

SEQ ID NO: 2877 - DNA, 415 bp, Homo sapiens
tccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaa

SEQ ID NO: 2878 - DNA, 326 bp, Homo sapiens
tccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggggtctgccttcacaaatgtcattgtctactcctaca

SEQ ID NO: 2879 - DNA, 324 bp, Homo sapiens
tccttatttatttaacttcacccgagttcctctgggtttctaagcagttatggtgatgacttagcgtcaagacatttgctgaactcagcacattcgggaccaatatatagtgggtacatcaagttcatctgacaaaatggggcagaagagaaaggactcagtgtgtgatccggtttctttttgctcgcccctgttttttgtagaatcttttcatgcttgacatacctaccagtattattcccgacgacacatatacatatgagaatataccttatttatttttgagtaggtgtctgccttcacaaatggcattggctactccag

SEQ ID NO: 2880 - DNA, 466 bp, Homo sapiens; identical to SEQ ID NO: 1118

SEQ ID NO: 2881 - DNA, 324 bp, Homo sapiens; identical to SEQ ID NO: 2879

SEQ ID NO: 2882 - DNA, 326 bp, Homo sapiens; identical to SEQ ID NO: 2878

SEQ ID NO: 2883 - DNA, 494 bp, Homo sapiens; identical to SEQ ID NO: 601

SEQ ID NO: 2884 - DNA, 243 bp, Homo sapiens
gccgctgcaccatgccccgcatagatgcggacctcaagctcgacttcaaggatgtcctgctccgacctaagcggacagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataa

SEQ ID NO: 2885 - DNA, 804 bp, Homo sapiens
gcaaatgtttgattaattctgctcatatgcacatctgaaagcatgagacacactccacagacagcacgcactggagctggtggggcagatgggcactcgccgattaggtattaatgtcaataatacgtgcataaagtgctgataaaataacttaagtgttacaaaaacagacagtccacggtggctgcaggcacatgcaggcgggactgggtcagacactccagggctgcacatgttccagctggcctgagtccgacacgtcatagctggccttgtacttggccaggattttcatgaggggccgtagcttgagccaccactgttctttgggaatcctgtgctcaaaatccgtttgcttcttcagctctgccacaggtttgaaaaataacgtttcttttgcttattcccagcacacaaatggaatcatcggtggtaaatttttttcctctgccccgggcctccttgagttttgcagtgatccactccatagctctggcagagattttggttccaaagtttctatcaaatggagagggtgccccaccctgctgcatgtgacccagcacgttcttcctgcagtcaaacacgcctttgccctcttctgaatacagctggtaaatgaagtcggtggtgtagttttcactgcagctctcatttctgagcacaaggcctctctggatggtggtcttcattttctccgtcaggtgctccacgttggactgcagatcctgatgtcgaagggctcttcgaaatgtatgcggcatcagtccggccgcagccccccatgttggcaggtagcacagt

SEQ ID NO: 2886 - DNA, 624 bp, Homo sapiens
  misc_feature 514: n = A,T,C or G
tggagttgtaggcaaatgtttaattaattctgctcatatgcacatctgaaagcatgagacacactccacagacagcacgcactggggctggtggggcagatgggcactcgccgattaggtattaatgtcaataatacgtgcataaagtgctgataaaataacttaagtgttacaaaaacagacagtccacggtggctgcaggcacatgcaggcgggactgggtcagacactccagggctgcacatgttccagctggcctgagtccgacacgtcatagctggccttgtacttggccaggattttcatgaggggccgtagcttgagccaccactgttctttgggaatcctgtgctcaaaatccgtttgcttcttcagctctgccacaggttgaaaaataacgtttcttttgcttattcccagcacacaaatggaatcatcggtggtaaatttttttcctctgccccgggcctccttgagttttgcagtgatccactccatagctctggcagagatnttggttccaaagtttctatcaaatggagaggtgccccaccctgctgatgtgaccccacacgttcttcctgagtcaaacacgcctttgccctcttctgaatacaagctggt

SEQ ID NO: 2887 - DNA, 507 bp, Homo sapiens
  misc_feature 301, 460, 498: n = A,T,C or G
ttttttggagttgtaggaaatgtttaattctgctcatatgcacatctgaaagcatgagacacactccacaagacagcacgcactggggctggtggggcagatgggcactcgcgattaggtattaatgttaataatacgtgcataaagtgctgataaaataacttaagtgttacaaaaacagacagtccacggtggctgcaggcacatgcaggcgggactgggtcagacactccagggctgcacatgttccagctggcctgagtcccgacacgtcatagctggccttgtacttggccagggnttttcatgaggggccctagctttgagccaccacttgttctttggggaatcctgtgcttcaaaatcccgttttgcttctttcagctcttcccacaggtttgaaaaataacgttttctttttgcttatttcccagcacacaaatgggattcatcggtgggnaatttttttcctctgccccggggcttcttgagtttttncagtgattc

SEQ ID NO: 2888 - DNA, 224 bp, Homo sapiens
  misc_feature 198, 219: n = A,T,C or G
atcagatcccaaagaccaattgcaacgtagctgtcatcaacgtgggggcacccgcggctgggatgaacgcggccgtacgctcagctgtgcgcgtgggcattgccgacggcacaggatgctcgccatctatgatggtttgacggcttcgcaagggccagatcaaagaaatcggctggacagatgtcgggggctggaccngccaaggaggctccattcttnggaca

SEQ ID NO: 2889 - DNA, 507 bp, Homo sapiens; identical to SEQ ID NO: 2887
  misc_feature 301, 460, 498: n = A,T,C or G

SEQ ID NO: 2890 - DNA, 224 bp, Homo sapiens; identical to SEQ ID NO: 2888
  misc_feature 198, 219: n = A,T,C or G

SEQ ID NO: 2891 - DNA, 232 bp, Homo sapiens
acgacagaagggtacggctgcgagaagacgacagatgggtacggctgtgagaagacgactgatgggaacagctaaggactgctaaaccccactctgcatcaactgaacgcaaatcagccactttaattaagctaagcccttactagaccaatgggacttaaacccacaaacacttagttaacagctaagcaccctaatcaactggcttcaatgtacttctcccgccgtcggg

SEQ ID NO: 2892 - DNA, 339 bp, Homo sapiens
tactggttttggagaacttgtctacaaccagggattgattttaaagatgtctttttttattttacttttttttaagcaccaaattttgttgtttttttttttttctcccttccccacaaatcccttttaaaatatttttgttaaccccctttccaacgggccgaggaaacttaaaacccctttttcctcggcctggttcctctttaatttttaatttttccccatcagtttaaaggttttggcatacttggcatcttttttcaaagggaaaactttttttgccattctttggacttccccttttttaaaggaaatgggggggccaaaaggggatttcaa

SEQ ID NO: 2893 - DNA, 456 bp, Homo sapiens; identical to SEQ ID NO: 1150

SEQ ID NO: 2894 - DNA, 490 bp, Homo sapiens
ttacattgaatactacatatgtcgagggaatgcagaaagagttaaggaaggcaggttgtcctgctatggaggccactcttcgttttccatgtactgcatgctgtttgtggcactttatcttcaagccaggatgaagggagactgggcaagactcttaccccccacactgcaatttggtcttgttgccgtatccatttatgtgggcctttctcgagttgctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatg

SEQ ID NO: 2895 - DNA, 334 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagattaaatgactgtgctg

SEQ ID NO: 2896 - DNA, 377 bp, Homo sapiens
  misc_feature 349: n = A,T,C or G
gaactcggtggtggccactgcgcagaccagacttcgctcgtactcgtgcgcctcgcttcgcttttcctccgcaaccatgtctgacaaacccgatatggctgaggtcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagacgcatagagggtggatcaagtttaaatgactgtgctgcccctttcacatcanagaactactgacaacgaaggccgcgcct

SEQ ID NO: 2897 - DNA, 555 bp, Homo sapiens
ctcggtggtggccactgcgcagaccagacttcgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttt

SEQ ID NO: 2898 - DNA, 300 bp, Homo sapiens
gctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcatgattggccaagtccattggggtgtcaaacttcaaccgcaggcagctggagatgatcctcaacaagccaggactcaagtacaagcctggctgcaaccaggtagaaagtcattcgtatttcaaccggagtaaattgctagaatcg

SEQ ID NO: 2899 - DNA, 344 bp, Homo sapiens
acagaagggtacggctgcgagaagacgacagaagggtacggctgcgagaagacgacagaagggtacggctgcgagaagacgacagaagggtaaaacactgaactgacaattaacagcccaatatctacaatcaaccgacaagtcattattaccctcactgtcaacccaacacaggcatgctcataaggaaaggttaaaaaaagtaaaaggaactcggcaaatcttaccccgcctgtttaccaaaaacatcacctgtagcatcaccagtattagaggcaccgcctgcccagtgacacatgtttaacggccgcggtaccctaaccgtgcaaaggtagcataatcac

SEQ ID NO: 2900 - DNA, 507 bp, Homo sapiens
tgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagttgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaa

SEQ ID NO: 2901 - DNA, 488 bp, Homo sapiens
gaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggaggacctgctccagcagctggtgctgcaccagcaggaggtcctgccccctgcactgctgctgctccagttgaggagaagaaagtggaagcatagaaagaagaatccgacgagtctgatgatgacatgggctatggtctttttgactaaacctcttttataacatgttcaataaaaagctgaactttaaaaagaaaaaaaaaaaactcgagcctctagaactata

SEQ ID NO: 2902 - DNA, 180 bp, Homo sapiens
ctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagc

SEQ ID NO: 2903 - DNA, 491 bp, Homo sapiens; identical to SEQ ID NO: 351
  misc_feature 12, 154, 255, 348, 368, 402, 409, 450, 471: n = A,T,C or G

SEQ ID NO: 2904 - DNA, 235 bp, Homo sapiens
tgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactt

SEQ ID NO: 2905 - DNA, 465 bp, Homo sapiens; identical to SEQ ID NO: 957

SEQ ID NO: 2906 - DNA, 243 bp, Homo sapiens
tgatttctgtggatcccagcttggttccaggaattttgtgtgattggcttaaatccagttttcaatcttcgacagctgggctggaacgtgaactcagtagctgaacctgtctgacccggtcacgttcttggatcctcacaactctttgctcttgtcggggtgggggtgggaactcacgtggggagcggtggctgagaaaatgtaaggattctggaatacatattccatgggactttccttccc

SEQ ID NO: 2907 - DNA, 506 bp, Homo sapiens; identical to SEQ ID NO: 1276

SEQ ID NO: 2908 - DNA, 390 bp, Homo sapiens
gtagtcgcctctctttcagcagttacccagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctggcacctataacaatcaatacatggttctggacctgaagaaagtaaagctgaaccacagtcttgacaaaggcactctgtacattgtggagcaaattcctacatatgtagaatattctgaacaaactgatgttctacggaaaggatattggccctcctaca

SEQ ID NO: 2909 - DNA, 372 bp, Homo sapiens
aggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacaaatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctc

SEQ ID NO: 2910 - DNA, 619 bp, Homo sapiens; identical to SEQ ID NO: 1153

SEQ ID NO: 2911 - DNA, 499 bp, Homo sapiens
taagctcggaattcggctcgagggctccagctgagctcctgcttctactgaggacatacctcccagatgaggtggggcccccaaccccattccctgagcctggagcagagccccctctcactgtgggcttgctcaaagccctgctggagcagactggggctcaaggatggctgtcgggcccagttctaagcccatatgaggacatcctatgggaccccagcactccacccccgactccacctcgggacctatgactacccttcaggcatcagaacactcagggcctggaggcttgcttgggactggaggcttgcttggacagttcctctgtgtcactgacacaggaaatcatttctaggacacagtgatcagggaagggtgcctgggacttggagggtcccatgtatggacctgtgtatgcaatactgttctgtcatctggagctatttttaagatgtgtgtgttaaatatatacatagtttaatatataaaaaaaaaa

SEQ ID NO: 2912 - DNA, 229 bp, Homo sapiens
ggctccagctgagctcctgcttctactgaggacatacctcccagatgaggtggggcccccaaccccattccctgagcctggagcagagccccctctcactgtgggcttgctcaaagccctgctggagcagactggggctcaaggatggctgtcgggcccagttctaagcccatatgaggacatcctatgggaccccagcactccacccccgactccacctcgggaccta

SEQ ID NO: 2913 - DNA, 467 bp, Homo sapiens
ggaagttctgcgctggtcggcggagtatcaagtggccatggggagcctcagcggtctgcgcctggcagcaggaagctgttttaggttatgtgaaagagatgttggcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttataaaagaaagctcgtctg

SEQ ID NO: 2914 - DNA, 338 bp, Homo sapiens
ggaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcagagatcaagatgcgag

SEQ ID NO: 2915 - DNA, 601 bp, Homo sapiens
tttgcacgatgccttccacatcccacggcgctgctgctgggggcagattggcctggggaggcagcacttgctctccagctcatctgggttgcttttccccgcagtggatatcacaggctaaaggggggggcagtccccaccatatttgagtctttctccaagttgcgccggacaaccaagaccaaaggacacagttacccacctggcccctctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccg

SEQ ID NO: 2916 - DNA, 52 bp, Homo sapiens
gccccttgggtgcccaggcagatgaagcaggctgcagcgcccagccttcacc

SEQ ID NO: 2917 - DNA, 525 bp, Homo sapiens
cgtttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttg

SEQ ID NO: 2918 - DNA, 604 bp, Homo sapiens
  misc_feature 12, 14, 18, 20, 24, 27, 29, 31, 33, 35, 54, 594, 595: n = A,T,C or G
ttcgaacccatncntttncnatcngananangntnctagttcttctgaagaccncatcgattcgtttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttannaaaaaaaaa

SEQ ID NO: 2919 - DNA, 285 bp, Homo sapiens
ctctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgctttaaggtga

SEQ ID NO: 2920 - DNA, 241 bp, Homo sapiens
atttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaaga

SEQ ID NO: 2921 - DNA, 315 bp, Homo sapiens
cggcttctggaagagggggtgttgcggcagatccctgtagtgggcttcgtgctgaattggttttctccggtccaggcttcacagtagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcatattgaagacttagaaaaggtggagcgccta

SEQ ID NO: 2922 - DNA, 164 bp, Homo sapiens
tggatcccccgggctgcaggaattcgaattctgtgtgtgtgtgtgtgtatgaatggtatatttattacattatttagaaagagaatgagtgtgttatgaggataatgttatatacagtctaagtggatgtttctgtttggcacagaatgtaggatttctgaaac

SEQ ID NO: 2923 - DNA, 206 bp, Homo sapiens
tatatttattacattattttgaaagagaattagtgtgttatgtggataatgttatatacagccaaagtggatgtttctgtttggcaaggaaggtaggatttctgaaactcaggccttaaccaataggttggaagacaagaccaattgaagagttaggaaatgtgagtttttgttacttctgttattccagtcttggtttcattgtc

SEQ ID NO: 2924 - DNA, 238 bp, Homo sapiens; identical to SEQ ID NO: 874
  misc_feature 159, 227: n = A,T,C or G

SEQ ID NO: 2925 - DNA, 504 bp, Homo sapiens
cggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccaccc

SEQ ID NO: 2926 - DNA, 814 bp, Homo sapiens
  misc_feature 38, 93, 94, 95, 422, 440, 467, 474, 508, 519, 529, 535, 554,557, 561, 565, 584, 594, 604, 619, 641, 655, 674, 679, 690,695, 702, 704, 706, 712, 716, 724, 734, 737, 740, 743, 780,781, 808, 813: n = A,T,C or G
cggggacggagctcggcgtgcttgctgctggagggttntggccctgcaaggctgtgggctccgacctcaccgggagtcgacagcgagaggttnnncgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgaccttttctgcggaagggctttctctacgtgctgttgctcatgggtttttgtcggagccccaacgcccttccggncttttgattcctggaaanaaaaggggttggttccccttcaagcanccccaancattccccgggaaaaaatgggggagccaaagggnttttggccaanggccccaatncccggnttcaacccgttgggttggnaantttnaccnaaattaacttcctttcctncaaggcccgnggaaaaaacnttttcccgggccacngggggggaaccaaccttgcaanggggccttgtaccnggtcttcaaacggcgggtnccaanaacccttgccnccatngaaaccnantnggaacncctngggggttnttccccaatnggngcnccnaaaaaacaaccccggttccaaccatttaagggaaaannggcgggggggccccaagggcccttttnggacnt

SEQ ID NO: 2927 - DNA, 375 bp, Homo sapiens
ctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgcagcgcccatcccgctccaccgtcgctgcagctcccaattactcttctgcaggcg

SEQ ID NO: 2928 - DNA, 405 bp, Homo sapiens
ggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggacc

SEQ ID NO: 2929 - DNA, 139 bp, Homo sapiens
ctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaat

SEQ ID NO: 2930 - DNA, 273 bp, Homo sapiens
ttctggctgggaagcgcgattgtggctttaaaccaccatcatggtctagcaaagaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccc

SEQ ID NO: 2931 - DNA, 56 bp, Homo sapiens
gggaaccgccattctgcctgggaaccgccattctggccgggaaccgccattatgac

SEQ ID NO: 2932 - DNA, 365 bp, Homo sapiens
ggcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtag

SEQ ID NO: 2933 - DNA, 119 bp, Homo sapiens
gagcggtggctgagaaatgtaaggattctggaatacatattccatgggactttccttccctctcctgcttcctcttttcctgctccctaacctttcgccgaatggggcagcaccactga

SEQ ID NO: 2934 - DNA, 421 bp, Homo sapiens
  misc_feature 130, 185, 246, 256, 336, 361, 385, 412: n = A,T,C or G
tttttttttttttttttggaaataagtcaaagcattgtttatttatgacatatttacatatttacaaaactgattttactcaatacatcatcctgcgtaatatcataaaatgaacaccatatcctgggantaaaaatccatatttcttaataatttatgtatagcccaacttttagaacatagantattatcaatttggcttcccaaactacaaagtcctgtttataattttttctagccaaggancagagtaggntcaacaggcatattaaagtaatttagttaaccctgaggtaattactaacttggcataattttggaatggggtatatatancacactttccatctggcacttaggntacttattactattcacactaccnttttggtatttatccacctcaattttncaacttcct

SEQ ID NO: 2935 - DNA, 481 bp, Homo sapiens
gggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaaatcccagctgggcaagcataacctatggagtgttcctttgcattgattgctcagggtcccaccggtcacttggtgttcacttgagttttattcgatctacagagttggattccagctggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgt

SEQ ID NO: 2936 - DNA, 136 bp, Homo sapiens
ggggtaagtttagaaatacggctgggcatgtccagccctgaccacggccagctctggagggctgtcctttggctgtacccacttggaagagaaagaaaaagaaaaaaaaaaaaaaaaaaaaaaatttttttttttt

SEQ ID NO: 2937 - DNA, 578 bp, Homo sapiens
aaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcattaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgccaatggatatttcgtgtgcctacagtggttcatatcccatggctataacccctactcaaaaaagaagatcctgtatgccacatc

SEQ ID NO: 2938 - DNA, 229 bp, Homo sapiens
  misc_feature 35, 37: n = A,T,C or G
gcctaggtgcccaggctatgatgagtctgcttttnanggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataac

SEQ ID NO: 2939 - DNA, 503 bp, Homo sapiens
tggtacgcctgcaggtaccggtccggaattcccgggtcgacccacgcgtccggcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtct

SEQ ID NO: 2940 - DNA, 248 bp, Homo sapiens; identical to SEQ ID NO: 54

SEQ ID NO: 2941 - DNA, 457 bp, Homo sapiens
atcttgtctcttttcatcgtgatggtgtgatgctgacgagaatatcttatgctttcttcagcctgttgcaatctgagccaatgattttctttgcactgatcctttctactctggagagaagctcttttgacacagatcctgccccgtttaatagactccagctgctggcactgccttctgagttctttcacttccgaattcttatcgtcctgcagccccaccacagtcaatgactaagttcctctggactttcacatggatcgtaatagacaacttcatcctgtttttcttaccagaccctaaaatgtgcctccaagacagtcgtgggaacagtatggagccagcagcagaagccactcacgaaccaatggaggagaacaactcagaaacagacccaagtcaatctaaggtttaacttttataagtctttcaagagagtccaactgtgtagtaagca

SEQ ID NO: 2942 - DNA, 589 bp, Homo sapiens
gcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctaaaagtcgcggtgcaggtgatggtgggagccgcgcctccagcgggcaggccgggagtgtactgtgtgc

SEQ ID NO: 2943 - DNA, 241 bp, Homo sapiens
cgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgagg

SEQ ID NO: 2944 - DNA, 221 bp, Homo sapiens
ttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtac

SEQ ID NO: 2945 - DNA, 228 bp, Homo sapiens
  misc_feature 191: n = A,T,C or G
gagctttcttaataaccgtacttctcaaaatcagagttttactgtttcaataaatgttcaccctagattgtaagttttttgttgttgagccctagatttttttctactagtgtaaatctgtattccctccaagtatggtgataaggggactgagtcttatttacatttgtacaatcactactttacctgtngtatttgcagtaagtcttttgagccctattaaacctg

SEQ ID NO: 2946 - DNA, 531 bp, Homo sapiens
tttcttaataaccgtacttctcaaaatcagagttttactgtttcaataaatgttcaccctagattgtaagttttttgttgttgagccctagatttttttctactagtgtaaatctgtattccctccaagtatggtgataaggggactgagtcttatttacatttgtacaatcactactttacctgttgtatttgcagtaagtcttttgagccctattaaacctgtcaattttcttgtcctgtcagaaaactgagattttggctcaaaaatggatgttattaacaaaggggaacaatatagatgtcttagtacaaagaaaatgaaatgtaagaggagattgtctggagttcaggggatagagtgtcaagtcttaaatggttacatctttttgctaagtgttactcagaatatagttacaaatatggtacttaaatatctagctgaaatttgtttgtcccatgagcttctcacatgagtctactgggcaattttatgtgagttttggtcaaaattggtaatctcttttatctt

SEQ ID NO: 2947 - DNA, 147 bp, Homo sapiens
  misc_feature 112: n = A,T,C or G
aacttgttacccaataacaatttaatgttaaatttggctttcttctgtgtcccagcctcttaaattaatagatgggcctttccattatcattatgaccggacattgtaaagnacttaaggtaacacccagttttctattacttgccc

SEQ ID NO: 2948 - DNA, 518 bp, Homo sapiens
acctgaagaatattagaagaaattgtgcaccctccacaaaacatacaaagtttaaaagtttggatctttttctcagcaggtatcagttgtaaataatgaattaggggccaaaatgcaaaacgaaaaatgaatcatctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctggaaaacaacacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctat

SEQ ID NO: 2949 - DNA, 76 bp, Homo sapiens
gctgctcatgagcagcatggacgacctgatacgccactgtaacgggaagctgggcagctacaaaatcaatggccgg

SEQ ID NO: 2950 - DNA, 308 bp, Homo sapiens
gagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctgacattttggtatctttcatctgaccatccatatccaatgttctcatttaaacattacccagcatcattg

SEQ ID NO: 2951 - DNA, 530 bp, Homo sapiens; identical to SEQ ID NO: 1397

SEQ ID NO: 2952 - DNA, 104 bp, Homo sapiens
ggacgtgcctggaaccacctcgtccacgtccacgtccacctgggggcctcgggaggctaggcccctcctcaaaggcccaccagcccggcgctcatgctgagccc

SEQ ID NO: 2953 - DNA, 417 bp, Homo sapiens
tatctttcatctgaccatccatatccaatgttctcatttaaacattacccagcatcattgtttataatcagaaactctggtccttctgtctggtggcacttaaagtcttttgtgccataatgcagcagtatggagggaggattttatggagaaatggggatagtcttcatgaccacaaataaataaaggaaaactaagctgcactgtgggttttgaaaaggttattatacttcttaacaattctttttttcagggacttttctagctgtatgactgttacttgaccttctttgaaaagcattcccaaaatgctctattttagatagtttaacattaaccaacataattttttttagatcgagtcagcataaatttctaagtcagcctctagtcgtggttcatctctttcacctgcat

SEQ ID NO: 2954 - DNA, 630 bp, Homo sapiens; identical to SEQ ID NO: 1287

SEQ ID NO: 2955 - DNA, 596 bp, Homo sapiens
tttttttttttttttttttttttggggtaaaagttatatcttattgccatgctacaaaatgtatgaagttggcactgatagggagaaatagagaacaaagggtgggaagggatagagggaaaattatgttgttacatatacaacaaggttttattttaattaacagtggttacgttttgccaatattaaaaatgcaaaccaaaatttaaaatgctgatctgaaacagcattaagatacaatgtatgcatagtacagtatcacttatgtctttttattagagaaatatggaatgtttataaaagaaattaaccatgggggtaaaattcatatttcatatacaatttggcaatggtagtcccactgttggacaattttttataaaagaaaaaattaaaaatctaataagctacctttatacaaagttgctatatttatgcctttacgtaggaaaaaaacatttataatgcaaattaggacatacaatagtcttacaatactatacaatgtaatgaaaataaaacataacacaaagtttgtcctttataaaatgtatattttgcattactaatgcaaatgtggcacactggtgactact

SEQ ID NO: 2956 - DNA, 559 bp, Homo sapiens
tggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaaagaagatccgcagtctaagtgaaggggtcaaaataggagcacatggaaaaccagtgatttttctccatcctaaagactgtggtggagtccttgtggaactggagcaagcttgacttatatt

SEQ ID NO: 2957 - DNA, 638 bp, Homo sapiens
tggcgggttgcgttccaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaaagaagatccgcagtctaagtgaaggggtcaaaataggagcacatggaaaaccagtgatttttctccatcctaaagactgtggtggagtccttgtggaactggagcaagcttgacttatatttgcaagcaactaaattaattgacctgaaaaagcctatcaaatactatcaaaatgtactatgacattgagtccttcactgc

SEQ ID NO: 2958 - DNA, 57 bp, Homo sapiens
gactacatttggggatgatgcattcctttaagattgaatgattctgcccttgggcag

SEQ ID NO: 2959 - DNA, 538 bp, Homo sapiens
gccgggctgctaattctgtttaattgttcctgggctaaaaagaattagaaggaagctgtctgtttcccactgcggttatgtttcagtaaattagacgtactttctgatgaatactaattagccactgagcatttgcacccactgtctttgctggttgtgtgcagaacagctgccaagttgcccaagaccctcgctatcccatccccctctcttgctttccacttttgggcttcctttgcctagattagaagagatttcagttccgagaaagtaaaaggtgatccaaggaagtaatcaccgagtgtctcatggtttttccttgttgacaaaattcaaaactcacacatgtgtagtctaatgatagcgctaggatttaaagaaagtgttttagtgctgtgcttatttaggactacatttggggatgatgcattcctttaagattgaatgattctgcccttgggcagagctcccaattagggaggattaggtaagctttttgtggcgatgggtaataccattcttttcctcattgtgcctg

SEQ ID NO: 2960 - DNA, 548 bp, Homo sapiens
tgaatcagtaggaatgtggggaagggagtgaggggagaccccctccttgactcagcagtggtgacggtcggtgtgtcctgcagacctgaagccaagatcaagggggcttgagcaccaggagcccccgcagttgctgaatgaccagcggagggcaggtgccagcctgtggcaaaataggaaagaaaaggacaggatggggacttcaccatttttttcagccttaaattgttccttaaaccttcatgtccttttctctaatgtgtgttcttgtttggtaaaataaaaaagtttgtaaccctgagttctctaaagatatacattcttttttactggtttgtgaagtcagaaggatgagagctgctatttcttggaaccgtgcaataaatattagcatattcagtctcggttctgcctagaggacctatttgcttttctttatctcgtaacccataactcacaggacattaaccagggtgtccaagaacagtctgggaaagttttgataattacttcagcattgctgtgtgatgggagacattgttttaaaa

SEQ ID NO: 2961 - DNA, 354 bp, Homo sapiens
tcagtgggagtgaatcagtaggaatgtggggaagggagtgaggggagaccccctccttgactcagcagtggtgacggtcggtgtgtcctgcagacctgaagccaagatcaagggggcttgagcaccaggagcccccgcagttgctgaatgaccagcggagggcaggtgccagcctgtggcaaaataggaaagaaaaggacaggatggggacttcaccatttttttcagccttaaattgttccttaaaccttcatgtccttttctctaatgtgtgttcttgtttggtaaaataaaaaagtttgtaaccctgagttctctaaagatatacattcttttttactggtttgtgaagtc

SEQ ID NO: 2962 - DNA, 570 bp, Homo sapiens
cttttataggattcatttaaaggtgaataaaataatgaatgtgaaactcatattagagcttaacatatagtagtaatgatttataaaatatttgcctcccttagaccagagcagctactaaatttgattttaataataagataaacaaattaataagatcacaaagttgttatgtaataacataaacagctgtgttaaaattagtagtgacccatatcaaagaaacacaattacaaagagattaagaaggataatatttaaagtgtagctttactcagtcttttgtgtgaaggtattcttagggataaaacaatgtatttggaagctgctggaagaatatggtgcaaagaatatttttaaatgcttgtgaatgttctgtaaccacaaacatagatacataacagatcaaagacatattttagactgccatgtggacttaaatcatgggaggcggaagagtggctccccaaagaggactatatcgtaataccagaacttgtgaatatattactttaagtggcaaaagggactttacagatgtgattaaaattaaggaccttgaaatggggg

SEQ ID NO: 2963 - DNA, 540 bp, Homo sapiens
aactagacttcttttataggattcatttaaaggtgaataaaataatgaatgtgaaactcatattagagcttaacatatagtagtaatgatttataaaatatttgcctcccttagaccagagcagctactaaatttgattttaataataagataaacaaattaataagatcacaaagttgttatgtaataacataaacagctgtgttaaaattagtagtgacccatatcaaagaaacacaattacaaagagattaagaaggataatatttaaagtgtagctttactcagtcttttgtgtgaaggtattcttagggataaaacaatgtatttggaagctgctggaagaatatggtgcaaagaatatttttaaatgcttgtgaatgttctgtaaccacaaacatagatacataacagatcaaagacatatttgagactggcatgtggacttaaatcatgggaggcggaagagtggctccccaaagaggactatatcgtagtaccagaacttgtgaatatattactttaagtggcaaaagggac

SEQ ID NO: 2964 - DNA, 622 bp, Homo sapiens; identical to SEQ ID NO: 1191

SEQ ID NO: 2965 - DNA, 378 bp, Homo sapiens
acaatgggtttgttctctgccttataaattgggggattctagaggagtctgcttttctcccaagaaggacctcttcttttcttgcttttcatatgctctccttgagatatcttgggtattctcatggctttaaatagcacttatatccagaagactcataaatctgcaatctaattatggcatctccagagttctgtattttaaaagttagcagaatctttaacgctgtggcaaagtttctggttttaagcgtaaaggtagtaatgagacatgaaaataccgtgaagccatcaaacctgtaatttaaaaaaataattgacagcattttggagaacaaagctccttgctgcatgtggggaataaaaagtaaataaaata

SEQ ID NO: 2966 - DNA, 396 bp, Homo sapiens; identical to SEQ ID NO: 1187

SEQ ID NO: 2967 - DNA, 529 bp, Homo sapiens
ttttttttttttttttttttttttttcggtagaaatggggttttaccatgttgcccaggctagtctcgaactcctgggcttaagcaatccacacacctcgcttccaaaaaagctggggttacaggtgtgagccatcacacccagcctaatatacaatctcaaatattttgttttaaatcattacttactgaactataaagtaaaactaatttttagacagcattttaatacatattttactttttaaaggttataaagaaaacactaacaatatggaaaatgcatatttaaagaaaattgaaatcaaatataatcttatggctcaaaatcattagtgttaatattttgatacctaccttccccatcttttgcctacgaatactgggttaagagtttttaaatagttttgtccttgctttgtaattttcgtatgttctcacaaaagagaagctgaggaagcatttggctattgggaaaattaattaatagatgttaacttaccaagatatactataatagattagacagc

SEQ ID NO: 2968 - DNA, 485 bp, Homo sapiens
tttaaagtaaatgactcatgttgaggaaagaggttattacctaaatctggactgcggcctaaggaaattcccttaacctctattctggtttcctatttcaaaatggttgtgtaggaggctaatggaagttagttggttgctatgatccaaaaactctatgggtgaaaatttaaagtacagatttcttatttaatcgttaaacagctttagttgtgagttctatgtcctggtataatggatcctgattattaatgcattaaatatgcattcagtgaattcaaatgttgctaattattcttttaccaatcaaagaaaactcaaagcatgggattaagaggggttggccaaaagtatttggaccaggttgcataccaggaccatgaagaaattgagaacagagcctacatcttttatactatggctcaaagcaagggctgttggaatgtgctgcttctccaaagtaggacttatgaaaaaatgagggt

SEQ ID NO: 2969 - DNA, 576 bp, Homo sapiens
tatcagcatctgtagaggagaaagcagaataagcactggggtatttgatagacttgagaataagagaaccccaaagttgtcaataggtatttgctagaaagttcagtgggtcagggtgggaatagcagctgaaattggcagggattttgactattcaaataatgggtgagtagaagggatctgtggaatagccattatgacctcttgaaaccaggcaactagggggtcccttctagaatgatgctgcgtacctaagaaattcagtagggagtggagtcaaaatgatcagaaaagatagagatagttgtggcaaaagatgatctaagagtgtgtgtgtatgtgtgtgagtgagagagagaaatctcaagaaatagtggctatggtgttgaacactacatgaaagcaacctaaaacagctgtgtgaagttagaaaaggtactctggaccatattgccctgtaaaagctcaggaaaactaattttgcataaacataagcaacaggaaattattgctgtcaaatctcattcagagttattgtacaaaaaaagagacaagaatccctatagacaatgaaag

SEQ ID NO: 2970 - DNA, 459 bp, Homo sapiens; identical to SEQ ID NO: 1165

SEQ ID NO: 2971 - DNA, 250 bp, Homo sapiens
tatacccaggatattatctaacgtgtctaacaggggtgttaatgatattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatctt

SEQ ID NO: 2972 - DNA, 509 bp, Homo sapiens
atactttatctattttcgggcaacttgcttccctcatgaaccatggacatctcaatgtgccattacacacaggagttatatgttaggtattgttgtcccattttacagaagagaatccgcaaggttcacagagtgaatcataggcataaagtccttcaggtggtaaatggcaaggctggtgttccaaccagtcttctctggctccagggactggctccttcagactacatttcaccagctgcctccaggaacagaagacgggaattcacctttcatgcgacatataccagaaacgtggacctcagccaccctgggtcctatttgatccccagggccttcatttggccctcgaataaaaaccttatttttttatctccttacctttcccagaattcatagtaggacttggctggtgaaaggctggttgctgagaaggctacagtgtggctaggctgcagttccctgttattacattgccccaggtattaatattgtatatttaggcagct

SEQ ID NO: 2973 - DNA, 554 bp, Homo sapiens
ggatttcaaatctgagatgatactttatctattttcgggcaacttgcttccctcatgaaccatggacatctcaatgtgccattacacacaggagttatatgttaggtattgttgtcccattttacagaagagaatccgcaaggttcacagagtgaatcataggcataaagtccttcaggtggtaaatggcaaggctggtgttccaaccagtcttctctggctccagggactggctccttcagactacatttcaccagctgcctccaggaacagaagacgggaattcacctttcatgcgacatataccagaaacgtggacctcagccaccctgggtcctatttgatccccagggccttcatttggccctcgaataaaaaccttatttttttatctccttacctttcccagaattcatagtaggacttggctggtgaaaggctggttgctgagaaggctacagtgtggctaggctgcagttccctgttattacattgccccaggtattaatattgtatatttaggcagctgttctcatccgtgcctggcagtgaaa

SEQ ID NO: 2974 - DNA, 537 bp, Homo sapiens
attctgaccccattgtgcaccttagtcatggcaaactttccagttgctccttgccaaaactcaagaataaaagggcccaagctagagaggctgtcctcacaagcatcagctgctgggggcttccactcattttcctctgaaacaacagagaaagagaccatctctcattcgcagagcagcccaaggccttctgaggagactgtgagtctcctctaagtcatttctctctgctttgtagcagtggagctaccaagggtgagatgagcaggttgagaggcctctgaagcctgctgggcacaatgctctgtgataagtttcagctccactggagcttatcatccaccagcaatcgacttcatggctgctgctcagaggccctaggtgctgcgctgctcactgccctcacgtctctgggacttccacacataaagccatctctttccattgcactatggcacttgtagggaggatcccacacttagggcccaaaatgagaccatttgagtcaaatttctaattgtctttcaaattttatta

SEQ ID NO: 2975 - DNA, 492 bp, Homo sapiens
attctgaccccattgtgcaccttagtcatggcaaactttccagttgctccttgccaaaactcaagaataaaagggcccaagctagagaggctgtcctcacaagcatcagctgctgggggcttccactcattttcctctgaaacaacagagaaagagaccatctctcattcgcagagcagcccaaggccttctgaggagactgtgagtctcctctaagtcatttctctctgctttgtagcagtggagctaccaagggtgagatgagcaggttgagaggcctctgaagcctgctgggcacaatgctctgtgataagtttcagctccactggagcttatcatccaccagcaatcgacttcatggctgctgctcagaggccctaggtgctgcgctgctcactgccctcacgtctctgggacttccacacataaagccatctctttccattgcactatggcacttgtagggaggatcccacacttagggcccaaatg

SEQ ID NO: 2976 - DNA, 509 bp, Homo sapiens
aagacattcaaattagccaccactggagtagatgacctaaaagttcttacaactctcaattatacccagtgatgtctcgattagcacttattataaaaattaaaatttataattcaacatttataccatccagaaaaagttaaaatatattaatagcctatttctcttcaataaagcgtatatataactctatttgttaatgtttctattctccatgacattctgtttatagataagccctatgctatttctagtcaagtgctaatctcttgaatgaagctgaattaggtagtcaactactagatgtatcctgaaaagcaagtaatgtgtatatttcatttattttatacataagagctacagactgttgtcacaatcttttcaagggctattaaattcattattttaactaacatttttgaacatctgtcttatgttgttaattgaggacatttctgaatgtataacaacataagaataatagttgttaaacttcaaagagatgacag

SEQ ID NO: 2977 - DNA, 649 bp, Homo sapiens
caaattagccaccactggagtagatgacctaaaagttcttacaactctcaattatacccagtgatgtctcgattagcacttattataaaaattaaaatttataattcaacatttataccatccagaaaaagttaaaatatattaatagcctatttctcttcaataaagcgtatatataactctatttgttaatgtttctattctccatgacattctgtttatagataagccctatgctatttctagtcaagtgctaatctcttgaatgaagctgaattaggtagtcaactactagatgtatcctgaaaagcaagtaatgtgtatatttcatttattttatacataagagctacagactgttgtcacaatcttttcaagggctattaaattcattattttaactaacatttttgaacatctgtcttatgttgttaattgaggacatttctgaatgtataacaacataagaataatagtttttaaacttcaaagagatgacaggttaatgagtaaaggagaaatatgaaatatcacagaattccttgacactaaatgatgttttgcaaatactgaacagaatgatgtttgtaaactttccactggttttcaagagtcccaaaacattaggaaaatgtacatcacctaactt

SEQ ID NO: 2978 - DNA, 494 bp, Homo sapiens
atatcagaagtaaaacaatttttcttgttgactgctttggtaaaaaacagtttgatggatagttttacatttcactggactagataaaaaatggtgctaatatttatgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttttgtactatagggtggatatggagttattcagtgcaagtgtgtgcttaatatcaaaccctatgcaaggagctatgtctagatttttggtccgaatttgcctccttcaagcctactagtgtgagatggaaaaaaatcgattgctcttttaatattatttccattttgaaattctcgacacttgaatgaaggcagtagaagcctctttttggatttctcttctaataacaaa

SEQ ID NO: 2979 - DNA, 630 bp, Homo sapiens
aaaacatttttcttgttgactgctttggtaaaaaacagtttgatggatagttttacatttcactggactagataaaaaatggtgctaatatttatgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttttgtactatagggtggatatggagttattcagtgcaagtgtgtgcttaatatcaaaccctatgcaaggagctatgtctagatttttggtccgaatttgcctccttcaagcctactagtgtgagatggaaaaaaatcgattgctcttttaatattatttccattttgaaattctcgacacttgaatgaaggcagtagaggcctctttttggatttctcttctaataacaaaactttatttagggaaggtttccctgtgctatcgtaagtttgttttgagcactgcattcactttaaaattctggaggaacaaaggctgggcacataatcacaaagcccaggccacacaataattccggggttgtattttctaagaacta

SEQ ID NO: 2980 - DNA, 156 bp, Homo sapiens
gggggagataaggcaaagaggcacttttggatttctccatctgagcagctctgtgattcattatctgttctagaaagcagcacacgcagttccagcaaaaaaaaaaaaaaaaaaaaatttttttttttttccccccttttttttttttttttcccc

SEQ ID NO: 2981 - DNA, 579 bp, Homo sapiens
attccgttgctgtcggcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccggg

SEQ ID NO: 2982 - DNA, 472 bp, Homo sapiens
ggcttagcggataacaatttcacacaggagctagcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctaaacacccgaagcgcacggccaccctcagcatgaggaacacgagcgtcatgaagaaagggggcatattctctgcagaatttctgaaagatttccttccatctctgctgctctctcatttgctggccatcggattggggatctatattggaaggcgtgtgacaacctccaccagcaccttttgatgaagaactggagtctgacttggttcgttagtggattacttctgagcttgcaacatagctcactg

SEQ ID NO: 2983 - DNA, 355 bp, Homo sapiens
tctacacttaaagctttggagcaattcccatcgaccagagttggtccgaccagccttggaaaggtcactgaaaaatcttcaattggactatggtgacctctatcttatacattttccattgtctgcaaagccaggtgaggaagtgatcccaaaagatgacaatggaaaaatactatttgacacagtggatctctgtgccacatgggaggccatggagaagtgtaaagatgcacgattggccaagtccatcggggtgtccaacttcaaccacaggctgctggagatgatcctcaacaagccagggctcaagtacaagcctgtctgcaaccaggtggaatgtcatccttacttcaac

SEQ ID NO: 2984 - DNA, 510 bp, Homo sapiens
aagactactgaatctgctaccaaaacagtgaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaac

SEQ ID NO: 2985 - DNA, 371 bp, Homo sapiens
ttccgttgctgtcggaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcaaaaactagaaatgtgaatgaggattattataaaagggg

SEQ ID NO: 2986 - DNA, 543 bp, Homo sapiens
aattccgttgctgtcggtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctg

SEQ ID NO: 2987 - DNA, 415 bp, Homo sapiens
ggcttactcactatagggcttttttttttttcgggtctattctttaattttactaaattaggaacgcagcttttacagaacaaataaccccaggggacggggcccccccaggatctaacagcttttcagggagctatgttgcaagctcaaaagtaatccactaacgaaccaagtcaaactccagtttttaataaaaaggggctgggggaggttgtcaaaccccttccaatataaatccccaatccgatggccaccaaatgaaaaagcaccagggatggaaggaaaactttcaaaaattctgcaaaaaatatgcccccttttttaatgaccctcgggttcctaatgctaaggggggccgcccccttcgggggttaaaaaaggaactccttggggggaatattttccggccgacttg

SEQ ID NO: 2988 - DNA, 240 bp, Homo sapiens
tttttttttttaaagtcatggaggccatggggttggcttgaaaccacctttggggggtccaatcccttccttttttgcctaaattttatgtatacgggttcttcaaatgcgtggtaggggggggggcatccatatagtccctccaggtttatggagggttcttctactattaggacttttcgcttcaaaacaaaggcttttcaaatcatgaaaatttttaattttcctgctgttaaaaaa

SEQ ID NO: 2989 - DNA, 293 bp, Homo sapiens
ttttttttttaataaatctcctaaggggatggctactttttctatctaaataataatatatagacctattcgatcagagatacaggggactaacaatcacaatcctgtgatcgacatccgaacataagtcactatctatcagaataaacaatgatccaacgaataatagaggagtaaggggacatgtccaaagcatcaggtatcgtcatgatcgaaaaccactgtcaagcaagacacaaacaaacaaaacagctttacacacaagtcagcagtccaagcgttcatgtcccaag

SEQ ID NO: 2990 - DNA, 221 bp, Homo sapiens
tttttttttttcaagggacactttaatggttaacttaagggatcatcaattttgcctcactacctacaaagggaatttcatcttgtccccatgctgagtagggaaacagggacaaagttaatcataataccctacatcaaaaaaaaactaagctaacactgctaactttttttttaacaggcaaaatataaatatatgccctctaaaatgcccaagggttt

SEQ ID NO: 2991 - DNA, 563 bp, Homo sapiens
ttccgttgctgtcgcctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagataacatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctc

SEQ ID NO: 2992 - DNA, 271 bp, Homo sapiens
ctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgtt

SEQ ID NO: 2993 - DNA, 342 bp, Homo sapiens
ggcttgtaatacgactcactatagggctttttttttttcgaattaaaaaaattccgttagccttttctccatctcctctaattctggtagcatctttggacccctaacacttggcatctgctacttcagacaaacaaaccctatgtaaatgacaaagaaggggcctcccaaccttctccctgtgttactatttcaaaagcactactcggggcacaggggtacaaatttcttatggccactagcatcttttttcaattttcaaaggaatcatcaaacatctgggtcaattatacttaaattacagaagcccggaattttaggcaacaggcccctcattttacc

SEQ ID NO: 2994 - DNA, 326 bp, Homo sapiens
ttttttttttaaaaagtcatggaggccatggggttggcttgaaaccagctttggggggttcgattccttccttttttgtctaaattttatgtatacgggttcttcaaatgtgtggtagggtggggggcatccatatagtcactccaggtttatggagggttcttctactattaggacttttcgcttcgaagcgaaggcttctcaaatcatgaaaattattaatattactgctgttagaaaaatgaatgagcctaccgatgataggatgtttcatgtggtgtatgcatcggggtagtccgagtaacgtcggggcattccggataggc

SEQ ID NO: 2995 - DNA, 55 bp, Homo sapiens
tttttttttttttttttttgagaaaccggggggggttttttttttaaaattgggg

SEQ ID NO: 2996 - DNA, 558 bp, Homo sapiens
cgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtcttcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggc

SEQ ID NO: 2997 - DNA, 370 bp, Homo sapiens
ggctagcggataacaatttcacacaggatggattggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcgaaaaaaaaaaagccctatagtgagtcgtattacaagccgaattcc

SEQ ID NO: 2998 - DNA, 560 bp, Homo sapiens
cagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcacc

SEQ ID NO: 2999 - DNA, 443 bp, Homo sapiens
ggcttgtaatacgactcactatagggcttttttttttgcaagtgctgtgggaagaaagttagatttacgccgatgaatatgatagtgaaatggattttggcgtaggtttggtctagggtgtagcctgagaataggggaaatcagtgaatgaagcctcctatgatggcaaatacagctcctattgataggacatagtggaagtgagctacaacgtagtacgtgtcgtgtagtacgatgtctagtgatgagtttgctaatacaatgccagtcaggccacctacggtgaaaagaaagatgaatcctagggctcaaagcactgcagcagatcatttcatattgcctccgtggagtgtggcgagtcagctaaatactttgacgccggtggggatagcgatgattatggtagcatcatcctgtgtgaaattgttatccgctaagccgaa

SEQ ID NO: 3000 - DNA, 249 bp, Homo sapiens
ttttttttttcgaaggatttggcaaagatttgtttttttttccatttccagttttttaaagtaaacacagatttgcttaaaataaagctgattttaaaagcccacaaaagttgaacacaaaggagaggattaaattccccaatgcagagtgataaaaaggaaaagatcctgagtaggtgccttcagcaaaaaactgatcatccagggtgatcacctaataatcggagacttaattccttataatgcaaa

SEQ ID NO: 3001 - DNA, 434 bp, Homo sapiens
tttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccggggg

SEQ ID NO: 3002 - DNA, 368 bp, Homo sapiens
tttttttttgcttatggagggttcctctactattaggacttttcgcttcgaagcgaaggcttctcaaatcatgaaaattattaatattactgctgttagagaagtgaatgaccctacagatgataggatgtttcatgtggtgtatgcatcggggtagtccgagtaacgtcggggcattccggataggccgaaaaagtgttgtgggaaaaaagttagatttaccccgatgaatatgatagtgaaatggattttggcgtaggtttggtctagggtgtaccctgagaataggggaaatcagtgaatgaagcctcctatgatggcaaatacagctcctattgataggacatagtggaagtgagctacaacgt

SEQ ID NO: 3003 - DNA, 482 bp, Homo sapiens
ccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaatttttttttatctaaaatgatt

SEQ ID NO: 3004 - DNA, 489 bp, Homo sapiens
tggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcggctctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcag

SEQ ID NO: 3005 - DNA, 25 bp, Homo sapiens
ggaatcaccgctttgccatcttcaa

SEQ ID NO: 3006 - DNA, 25 bp, Homo sapiens
aacttctaccgtttcgccactaagg

SEQ ID NO: 3007 - DNA, 23 bp, Homo sapiens
gaccgtgtactgcgtgtcgtgcg

SEQ ID NO: 3008 - DNA, 23 bp, Homo sapiens
gcgtgctgtgcgtcatgtgccag

SEQ ID NO: 3009 - DNA, 24 bp, Homo sapiens
gccgtcttcaggcaacaactccca

SEQ ID NO: 3010 - DNA, 24 bp, Homo sapiens
tgctggacgaggctgtcatcttgc

SEQ ID NO: 3011 - DNA, 25 bp, Homo sapiens
acagggagaaaactggttgtcctgg

SEQ ID NO: 3012 - DNA, 23 bp, Homo sapiens
aaggcagaacccatccactccaa

SEQ ID NO: 3013 - DNA, 25 bp, Homo sapiens
gctgctggattcgtttggcataact

SEQ ID NO: 3014 - DNA, 25 bp, Homo sapiens
tcaatacggtttgcttaggtcgtcg

SEQ ID NO: 3015 - DNA, 24 bp, Homo sapiens
tctcctctgagttcaaccgctgct

SEQ ID NO: 3016 - DNA, 24 bp, Homo sapiens
tcgtcgccaacttgagtctcctct

SEQ ID NO: 3017 - protein, 406 aa, Homo sapiens
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 3018 - DNA, 1221 bp, Homo sapiens
atggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataa

SEQ ID NO: 3019 - DNA, 338 bp, Homo sapiens
gtgctgtccccggcataggtccatctctgcagaagccatttcaggagtacctggaggctcaacggcagaagcttcaccacaaaagcgaaatgggcacaccacagggagaaaactgcttgtcctggatgtttgaaaagtcggtcgatgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttatattgggaggactccaagccgggaaggaaaattccctttt

SEQ ID NO: 3020 - DNA, 186 bp, Homo sapiens
tgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctt

SEQ ID NO: 3021 - DNA, 118 bp, Homo sapiens
acagggagaaaactggttgtcctggatgtttgaaaagttggtcgttgtcatggtgtgttacttcatcctatctatcattaactccatggcacaaagttatgccaaacgaatccagcag

SEQ ID NO: 3022 - DNA, 527 bp, Homo sapiens
gcccagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggccacctgggctccaccagcccagcccccctgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctccgctggctcctgtctgaacctcctcgcagggccaaaggctggcttggcctgtgtttcccct

SEQ ID NO: 3023 - DNA, 594 bp, Homo sapiens
gtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggcatgtacaacgccaccacccggcaggtggaaacggagctcttcccctgcctcaggcactttggactgaggttctatgcctacaaccctctggctgggggcctgctgactggcaagtacaagtatgaggacaaggacgggaaacagcctgtgggccgcttctttgggaatagctgggct

SEQ ID NO: 3024 - DNA, 532 bp, Homo sapiens
ccggaggtcgcacgcgggttccagttgtgattgctggagttgtgtattgccaggaggctctccgagattggggtcgggtcactgcctcatccaccggagcgatggcgtttctccgaagcatgtggggcgtgctgactgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgac

SEQ ID NO: 3025 - DNA, 506 bp, Homo sapiens
gctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagagggatgtattgtcctctagagtcagaactggccgaagcat

SEQ ID NO: 3026 - DNA, 365 bp, Homo sapiens
ggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttt

SEQ ID NO: 3027 - DNA, 632 bp, Homo sapiens
cctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagcccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaataaaaaactgaccatctagtccttgtcatctgggcaccctcaaaaaaagcc

SEQ ID NO: 3028 - DNA, 486 bp, Homo sapiens
cagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatagcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgag

SEQ ID NO: 3029 - DNA, 579 bp, Homo sapiens
ttccgttgctgtcggctatcccacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaaagttgatagattagttagaacttcagatcatcagatcagtctcaaatgggtttcttggaatttatatttgacaatatttatactataccaaactcatttgcagttctt

SEQ ID NO: 3030 - DNA, 342 bp, Homo sapiens
acatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgcttaaataaatgttttatatttgtatacaatcaaattgattaattttcatgacttatttcacgatataaagcaaattattttctaagacatttacagtgtttgttttcctatgtttacatgtgctcatttcacgtcatgtattttcctctacgacatgtttctgtgtgagtagttaacatgt

SEQ ID NO: 3031 - DNA, 288 bp, Homo sapiens
ccgttgctgtcggacccttccagcatgccagaggaaagttcccccaggcggaccgcgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatg

SEQ ID NO: 3032 - DNA, 363 bp, Homo sapiens
ccgttgctgtcgcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagccc

SEQ ID NO: 3033 - DNA, 368 bp, Homo sapiens
ggcacgagggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgtt

SEQ ID NO: 3034 - DNA, 202 bp, Homo sapiens
tgccaaatcaagagagatatcaacagaaggagagccatgcgtactttctaaaaactgatggtgaaaagctcttaccgaagcaaccaaattcagcagacacctcttcagcttgagttcttcaccatcttttgcaactgaaatatgatggatatgcttaagtacaactgatggcatgaaaaaaatcaaatttttgatttattat

SEQ ID NO: 3035 - DNA, 534 bp, Homo sapiens
ccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaa

SEQ ID NO: 3036 - DNA, 546 bp, Homo sapiens
tcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagaga

SEQ ID NO: 3037 - DNA, 300 bp, Homo sapiens
tgctttttaaaaggggcaaatccccggccccaaaaccccttgggggccggggcccttttccttggggttaaatttcgggggggggggggtatttccccaaaaattgggggaatcctagggtttttgggttttttcccaaaaatttttttttttttgggaagaaaaaaacacccccttgggggggcccttgggaaacccccttttttccaatttttaaaaaaaatttttcccccaaaggggatttaaaaaagacttttgggaaaaggcaccccttttttccccaaaactttttttttttgg

SEQ ID NO: 3038 - DNA, 536 bp, Homo sapiens
catcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccac

SEQ ID NO: 3039 - DNA, 467 bp, Homo sapiens; identical to SEQ ID NO: 357

SEQ ID NO: 3040 - DNA, 242 bp, Homo sapiens
ccgttgctgtcgcttcgtgtaagcaagtacataaggaccctcctttggtgaaatcggggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggt

SEQ ID NO: 3041 - DNA, 467 bp, Homo sapiens; identical to SEQ ID NO: 359

SEQ ID NO: 3042 - DNA, 496 bp, Homo sapiens
tgatgaaggccctcctggccgggcccctccggcccgggcgcgtcgctggaggaacccgattccctttcccgagacgtttgacggagataccgaccgactcccggagttcatcgtgcagacgtgctcctacatgttcgtggacgagaacacgttctccaacgacgccctgaagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttttcttctgaatttgcagctgtctctctgat

SEQ ID NO: 3043 - DNA, 372 bp, Homo sapiens
tcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttc

SEQ ID NO: 3044 - DNA, 465 bp, Homo sapiens
tgtcgggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccacaaaaccttctagacaatgatccctcatttttctgtaggtttactgttgtagttgcaactcaacttcctgaaagcacttcacta

SEQ ID NO: 3045 - DNA, 426 bp, Homo sapiens
ttgctgtcggcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcg

SEQ ID NO: 3046 - DNA, 488 bp, Homo sapiens
cgaattcggcacgaggcaatggcttcaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctc

SEQ ID NO: 3047 - DNA, 584 bp, Homo sapiens
tgctgtcgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagct

SEQ ID NO: 3048 - DNA, 107 bp, Homo sapiens
tttaaaattccaatatagaatctgacttgcaaactctagctgcagcatgtggagcttctagatgtttactaccttgaatggttgtcagtgtcactgaaccacagggg

SEQ ID NO: 3049 - DNA, 472 bp, Homo sapiens
ggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacgtattcccgaagccgttaccttgaatgcatttcctgtggctcatcagacatgagctgtgagaggggccggcaccagagcctgcagtgccgcagccctgaagaacagtgcctggatgtggtgacccactggat

SEQ ID NO: 3050 - DNA, 520 bp, Homo sapiens
gaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcac

SEQ ID NO: 3051 - DNA, 587 bp, Homo sapiens
ggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctca

SEQ ID NO: 3052 - DNA, 523 bp, Homo sapiens
ttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatattc

SEQ ID NO: 3053 - DNA, 672 bp, Homo sapiens
gccgttccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaaca

SEQ ID NO: 3054 - DNA, 543 bp, Homo sapiens
gccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgca

SEQ ID NO: 3055 - DNA, 466 bp, Homo sapiens
cgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagccc

SEQ ID NO: 3056 - DNA, 492 bp, Homo sapiens
tccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaatt

SEQ ID NO: 3057 - DNA, 96 bp, Homo sapiens
tttgcatccagccctgagacatgtaggaaacacctttcagacccaggctctgaagattcccagaagccacaaggattgaagggaaaaggtgatcct

SEQ ID NO: 3058 - DNA, 580 bp, Homo sapiens
tcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgaagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaat

SEQ ID NO: 3059 - DNA, 572 bp, Homo sapiens
gttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacagg

SEQ ID NO: 3060 - DNA, 494 bp, Homo sapiens
ccccctgcctgagcgtccccgggaaaaagaagaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcaggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacct

SEQ ID NO: 3061 - DNA, 448 bp, Homo sapiens; identical to SEQ ID NO: 369

SEQ ID NO: 3062 - DNA, 248 bp, Homo sapiens
tcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgt

SEQ ID NO: 3063 - DNA, 494 bp, Homo sapiens
gtcgttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagc

SEQ ID NO: 3064 - DNA, 341 bp, Homo sapiens
cgttgctgtcggtgttgcccaggctggtctcaaactgcattcaagcagtcctcctgcatcggcctctgaaagtgctgggattataggcatgaaccaccacacctgacttcccccatactttcttattaattaccatactgtatatttttattttgtttaaacatcttttcttcccacttttatcgtttttacttgagtgcttaattcatcttcctaaattaatttaaaaactcatctttaagactgtgaattttcttccgaatatacctttggccacagttcaaagactttgatgtgttactcttttggcattggttctaaaatgtcaatcattctttttt

SEQ ID NO: 3065 - DNA, 557 bp, Homo sapiens
ccaaccagcagcagccatcatggaggcgcctggggctgtggagatccggagtcgccacagctcctaccccgcggggacggaggacgacgaagggatgggggaggagcccagcccctttcggggccgctcgcgcctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccgggtgcgtgtgaagccacggaaggcttggtcccatcggaagttttgggttttccgcccacagc

SEQ ID NO: 3066 - DNA, 555 bp, Homo sapiens
ttgggggcagccaggcacagccggctcacggaggggccaccacactgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggggagcattcctagacccctgggtgcttgtctgcacagagctctggtctgtgccaccttggccaggctggctgtggg

SEQ ID NO: 3067 - DNA, 602 bp, Homo sapiens
tgtaatggcccgactgttgagtgagggggagcaggggatcccaacggcttgcgctgcctttgcgcagcagccggcgggcggccacgtcgcggcctggctggggagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaaggcctctagaactatagtgagtcgtattacgt

SEQ ID NO: 3068 - DNA, 565 bp, Homo sapiens
ccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgc

SEQ ID NO: 3069 - DNA, 476 bp, Homo sapiens
ttccgttgctgtcggccagcagctaggactgggagagataggagaagtaggactgctgtgattaggacggatcagacgaagaggggcgtttggtattgggttatggcagggggttttatattgataattgttgtgatgaaattgatggcccctaagatagaagagacacctgctaggtgtaaggagaagatggttaggtctacggaggctccagggtgggagtagttccctgctaagggagggtagactgttcaacctgttcctgctccggcctccactatagcagatgcgagcaggagtaggagagaggggggtaagagtcagaagcttatgttgtttatgcggggaaacgccatatcgggggcaccgattattaggggaactagtcagttgccaaagcctccgattatgatgggtattactatgaagaagattattacaaatgcatgggctgtgacgataacgttgtagatgtg

SEQ ID NO: 3070 - DNA, 488 bp, Homo sapiens
tccgttgctgtcggtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatga

SEQ ID NO: 3071 - DNA, 456 bp, Homo sapiens; identical to SEQ ID NO: 2710

SEQ ID NO: 3072 - DNA, 476 bp, Homo sapiens
aattccgttgctgtcggtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgact

SEQ ID NO: 3073 - DNA, 653 bp, Homo sapiens
  misc_feature 84, 88, 107, 119, 138, 143, 161, 186, 225, 258, 262, 263,272, 280, 282, 290, 293, 309, 338, 359, 367, 373, 374, 430,449, 450, 499, 524, 558, 590, 638: n = A,T,C or G
ggcacgagccctttgagatttctggctttttgtagggacctcagttccattttcccaactcatgggttctcaataccttaactntctnttatttgtcaaattccaantcctcaaaatcncccaccattacctgacccnctggnagtcaccacaccaccttncccactttcccagggatgcttatgnattagcttaaatcctcaccattctgatttgtaatgccgnccccaccccctttttttgacacctgggagttancttnnctttctggnaagatcancntcacacanacnagcacattttcttatnatactttatctagaaaacccatgtgtcantggcagaagcatcctgaattntggtagancattgnntcgctggactggaacctcctgaaacacagcagtgggaattgcttgtaatccgctgngtctatcatcaacaaaagnnaatattgtattttttcaggggtaatttaacataagaaggttaacatttnccattcaatttaaaactaaaaacangcccgggtgcggtggctcacgcctgtgatcccancctttgggaggccgaggtgggtggatcacgangtcaaggagattgagaccattctggctaacgcagtgaaaacccgtctntactaaaaaacaaat

SEQ ID NO: 3074 - DNA, 477 bp, Homo sapiens
ggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaa

SEQ ID NO: 3075 - DNA, 622 bp, Homo sapiens
  misc_feature 255, 602, 615: n = A,T,C or G
ggcacgagggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctangaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaaagggcaaggccctgatgtataggttncaccattactcanacttcta

SEQ ID NO: 3076 - DNA, 591 bp, Homo sapiens
gatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataagagatgatagaaaaaagccttcacttcaaagaagtcaaatttcatgaagaaaacctctggcacattgacaaatactaaatgtgcaagtatat

SEQ ID NO: 3077 - DNA, 521 bp, Homo sapiens
ccgttgctgtcggccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcagga

SEQ ID NO: 3078 - DNA, 513 bp, Homo sapiens
tcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatct

SEQ ID NO: 3079 - DNA, 486 bp, Homo sapiens
ggccacgctgccatcgactacacgcagctgggcctgcggttcaagctgcaagcctgggaggtgctacacaatgtggcgtcggcacagtgccagctggggctctggacagaggcggccagcagcctaagggaggccatgtccaagtggccggaggggtccctgaatggcctggactcagccctggaccaagtgcagagacggggctcactgccgccacggcaggtccccaggggcgaggtcttccggccccaccggtggcacctgaagcacttggagcccgtggatttcctgggcaaggccaaggtggtggcctctgccatccccgacgaccagggctggggcgtccgccctcagcagccacagggaccaggagcgaaccatgatgccaggtccctaatcatggactccccaagagctggcacccaccagggccccctcgatgcagagacagaggtcggtgctgaccgctgcacgtcgactgcctac

SEQ ID NO: 3080 - DNA, 560 bp, Homo sapiens
ggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctac

SEQ ID NO: 3081 - DNA, 560 bp, Homo sapiens
gaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaagagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccaca

SEQ ID NO: 3082 - DNA, 389 bp, Homo sapiens
agctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggat

SEQ ID NO: 3083 - DNA, 542 bp, Homo sapiens
gactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaatt

SEQ ID NO: 3084 - DNA, 652 bp, Homo sapiens
tgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagc

SEQ ID NO: 3085 - DNA, 228 bp, Homo sapiens
ggccacatggtgtcagatgaatatgagcagctgtcctatgaagccctggaggctgcccgaatctgttccaataagtacatggttaaaagttgcggcaaatatggctaccatatccaggtgcggctccaccccttccacgtcatacgcatcaacaagatgttgctctgtgctggggctgacaggctccaaacaggcatgcgaggtgccttaggaaagccccatggcact

SEQ ID NO: 3086 - DNA, 549 bp, Homo sapiens
atcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctc

SEQ ID NO: 3087 - DNA, 356 bp, Homo sapiens
gaaaaacaaacaaacatatacacagaatacttttacctttttattttgaaataattatagactcacaggaagtttcaaaagtagtacatggagtcccatgaacccttcaccccctcttccttcaatggtgacatataactgtagcacactgtcacaaccaggaaattgacattagtataatactgttaaccaaactatgggcctcactgggttttaagcagcacttgtgtgtgtgtggttgtgcgtgcctgtgtgtgtatgtgtgtgtgtgtagtattatgcagttttatcccatgcataaattcatgtaaccactcccacaatcaagatacagaatcgttctatagaatatcttt

SEQ ID NO: 3088 - DNA, 568 bp, Homo sapiens
gccgcgtgacttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaag

SEQ ID NO: 3089 - DNA, 494 bp, Homo sapiens
ccgttgctgtcgcggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaac

SEQ ID NO: 3090 - DNA, 463 bp, Homo sapiens; identical to SEQ ID NO: 344

SEQ ID NO: 3091 - DNA, 526 bp, Homo sapiens
ccccctgcttaccgacgagtgccggaccctgcagagctgtaagactggcaaggccaagatcaccggcggctatcggctcccggccaagtacgtcatccacacagtggggcccatcgcctacggggagcccagcgccagccaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggc

SEQ ID NO: 3092 - DNA, 645 bp, Homo sapiens
agctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtgccccacatcctctcctccgggacagtcaccgaaaacacaggttccaaagtctacctggtgcctgagagcccagggcccttcctccgttttaagggggaagcaacatttggaggggacggatgggctggtcagctggtctccttttcctactcatactata

SEQ ID NO: 3093 - DNA, 374 bp, Homo sapiens
attccgttgctgtcggacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattct

SEQ ID NO: 3094 - DNA, 289 bp, Homo sapiens
aagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaat

SEQ ID NO: 3095 - DNA, 733 bp, Homo sapiens
  misc_feature 44, 451, 623, 630, 686, 717: n = A,T,C or G
cagcattcagttgtaccctaacgagtttccaggtagtgaccctngagattgtcccagagacctgccgaagaatgccgctttgaaattggggtgcatcaatgctgagtatcccgactccttcggccattatagagaggccaaattctcccagaccaaacatcactggtggtggaagctgcattttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcanaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtngaccatncactcagagtgcccaaattgagtcactcttaaataataaccaacaatacatgtttncagaaactctactataatgaaaagttactgnggtagcccattttcct

SEQ ID NO: 3096 - DNA, 375 bp, Homo sapiens
  misc_feature 375: n = A,T,C or G
ggcacgagaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctan

SEQ ID NO: 3097 - DNA, 167 bp, Homo sapiens
gcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgctcgacaacacat

SEQ ID NO: 3098 - DNA, 503 bp, Homo sapiens
ttttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaa

SEQ ID NO: 3099 - DNA, 578 bp, Homo sapiens
gttgctgtcgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaaatgaaacatcagcctgccatcgtctagaagagacattggcagttaaaaattagcacctccagtgtagtcgcctggcactgcccatcatgctgagggagcagattcttcccaaggcagcttcagctaggagtttgtaagcaaggactttgtgacacatttgtcccctggaactgagccttt

SEQ ID NO: 3100 - DNA, 639 bp, Homo sapiens
tgctgtcggtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaatt

SEQ ID NO: 3101 - DNA, 486 bp, Homo sapiens
ccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaaacagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaata

SEQ ID NO: 3102 - DNA, 290 bp, Homo sapiens
ggcacgagagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaag

SEQ ID NO: 3103 - DNA, 552 bp, Homo sapiens
attccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaata

SEQ ID NO: 3104 - DNA, 471 bp, Homo sapiens
ttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaa

SEQ ID NO: 3105 - DNA, 516 bp, Homo sapiens
ctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaac

SEQ ID NO: 3106 - DNA, 413 bp, Homo sapiens
tagctgctctacggtcatctttgcttagagtatgctttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaaccca

SEQ ID NO: 3107 - DNA, 514 bp, Homo sapiens
  misc_feature 232: n = A,T,C or G
ctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctancaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctataaaa

SEQ ID NO: 3108 - DNA, 238 bp, Homo sapiens
ctgtttgtcaaagcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggctt

SEQ ID NO: 3109 - DNA, 492 bp, Homo sapiens
gcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcaaccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctt

SEQ ID NO: 3110 - DNA, 507 bp, Homo sapiens
ggcacgaggccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcataaaaaaaaaaataaataaataaaaaaaaaaactcgagcctctagaactatagtgagtcgtattacgtagatccagacatgataaga

SEQ ID NO: 3111 - DNA, 593 bp, Homo sapiens
ttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaac

SEQ ID NO: 3112 - DNA, 160 bp, Homo sapiens
taatgacaaccaggaattttatcaggatacttatgggcaacagtggaagtagacaagtaagggcttgaaaatgatactggcaagatacgattggctctagatctacattcttcaaaaaaaaaaatgggcttaactgtttcatctttaagtaccattttgc

SEQ ID NO: 3113 - DNA, 392 bp, Homo sapiens
  misc_feature 392: n = A,T,C or G
ggcacgagctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtaaggagcaggatcatgccagaaatagggatggaagtgcatcctctgggan

SEQ ID NO: 3114 - DNA, 423 bp, Homo sapiens
cagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcatt

SEQ ID NO: 3115 - DNA, 358 bp, Homo sapiens
gaatccgaagaagcggcctgtggcagcaagaagcgggtagtgccaggtattgtgtacctgggccatatcccgccgcgctttcggcccctgcacgtacgcaaccttctcagcgcctatggcgaggtctgacgcgtcttctttcaggctgaggaccggttcgtgagactcaagaagaatgcagcagcagctgcctgagggaaaaagcggtcctacaccaacgactacaccgagggatgggtggagttccgtgacaagcgcataaccaagcgcgtggcggtcagtctacacaacacgcctatgggtgcccgcatgcgcagacccttccgatatgatctttggaacctcaagtacttgcacc

SEQ ID NO: 3116 - DNA, 564 bp, Homo sapiens
gaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagag

SEQ ID NO: 3117 - DNA, 556 bp, Homo sapiens
cagtcggatttctgtccttggtacattggattaccgtttattccatatgtggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgct

SEQ ID NO: 3118 - DNA, 450 bp, Homo sapiens
gtcggcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatg

SEQ ID NO: 3119 - DNA, 465 bp, Homo sapiens
attccgttgctgtcggccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgac

SEQ ID NO: 3120 - DNA, 182 bp, Homo sapiens
ctctacacttatcatctacacaattataatggtactgactatcctagaaatcgctgccgccttaatccaagcctacgttttcacacttctagtaagcctctacctgcacgacaacacataaaaaaaaaaaaaaaaaaaaacccggccctttaaaatttaagggggtttttttccttaaaccc

SEQ ID NO: 3121 - DNA, 552 bp, Homo sapiens
ccgttgctgtcgtgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatg

SEQ ID NO: 3122 - DNA, 590 bp, Homo sapiens
  misc_feature 362: n = A,T,C or G
tccgttgctgtcggcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttanaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacac

SEQ ID NO: 3123 - DNA, 520 bp, Homo sapiens
ttccgttgctgtcgagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtataaacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatag

SEQ ID NO: 3124 - DNA, 519 bp, Homo sapiens
gtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatg

SEQ ID NO: 3125 - DNA, 501 bp, Homo sapiens
ggcacgagggagtcttgctgtgtctcccaggctagagtgcagtggcatgatctcggctcactgcaatctctacctcccgggttcaagcgattctcctgcctcagccttgtgagtagctgggattacaggcatgtgccaccacgcccaactaatttttgtatttttagtagatatggggtttcaccgtgttggtcaggctggtctcgaactcctgacctcatgatccacccacctcagcttcccgaagtgctgtgattacaggcatgagccacagcacacagcccatctttttttaaactatgtttgtttaatcatcacaaatctattcatctatccactcctttatttatctatccacctcttattttgtacacatttcaaagtaaactatagacatctgtatacttatctttaaatatttcaatatgtacatcattaactggtgttaagtatttctttatagcttttcctcttggtggaaagtttacatacaaagaaatg

SEQ ID NO: 3126 - DNA, 376 bp, Homo sapiens
ggcacgaggtctgcaggcactcagaatggtccacgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaat

SEQ ID NO: 3127 - DNA, 479 bp, Homo sapiens
ttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaaga

SEQ ID NO: 3128 - DNA, 321 bp, Homo sapiens
gctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagctt

SEQ ID NO: 3129 - DNA, 579 bp, Homo sapiens
cgctgctgcccctttctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaaaaaaaaaaa

SEQ ID NO: 3130 - DNA, 621 bp, Homo sapiens
ctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtat

SEQ ID NO: 3131 - DNA, 485 bp, Homo sapiens
gcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactactt

SEQ ID NO: 3132 - DNA, 466 bp, Homo sapiens
tgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttatccaggagaatgggtctcttgttgaaatccgaaatttcttgggtgaaaaatatatccgcagggttcggatgagaccacgtgttgcttgttcagtatctcaagcccagaaagatgaattaatccttgaaggaaatgacattgagcttgtttcaaattc

SEQ ID NO: 3133 - DNA, 463 bp, Homo sapiens
cagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatatt

SEQ ID NO: 3134 - DNA, 431 bp, Homo sapiens
gggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattggcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttactt

SEQ ID NO: 3135 - DNA, 297 bp, Homo sapiens
  misc_feature 260, 267, 268, 269, 274, 277, 281, 282, 284, 285: n = A,T,C or G
aattccgttgctgtcgctttcttcttgcacctaaaagtggagactgggtgcaaatgtaagcagtggtggatccagaaatatgaactttgtgtaataagcttcttaaaacagtcctttcttacacctgcccagggccagaccctcggtcttggcctttttcaggagctaggatatctgcgcctggtgaaaatgaaacgaattcctgatttaggaattcagtgtttcctcctcactccagctaagcactcactttttttttnttttttnnnaacanggntatnntnntgcacccaagcc

SEQ ID NO: 3136 - DNA, 520 bp, Homo sapiens
ccgttgctgtcggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgat

SEQ ID NO: 3137 - DNA, 215 bp, Homo sapiens
gcccttagcgtggtcgcggccgaggtaccatgctgacttcttggtatcttttaaggcctaattttcccttccttgagattactgtagtgtgttccagctaatttctatttggaaacgagttggaacagctgaaaactaggtattattgaaggcaaagcagcctcacgtcagttttttatcagctcatttgggaagtttttttttttttttttttt

SEQ ID NO: 3138 - DNA, 472 bp, Homo sapiens
gcccttagcgtggtcgcggccgaggtacctggggtctcagggttgctctgggcctgatcatccactcagatctgtaaggaggatttgcaggatccatttagaaagatcctcccttacttccacaagcatggcctttggctcttaaatacctgtgctggggttttgtaattatagaaacaacaggaaccaaaactcattaatgttgagctacaaaccagagggaagcttctttctcaaaacagggctcaggcctagaaaaatctagttttctgaaatcgctagccagcaacagcactgagatggccatcccagaaacaaggccaacacagaagcacccataaaggctgctggaggttgggacaaagagatccttgctgtccttacagaccccctgacttccaaggagctcccctctcacccagcctggcctgccttctccacagggtagctgatcgtcagcatcatcttcaat

SEQ ID NO: 3139 - DNA, 405 bp, Homo sapiens; identical to SEQ ID NO: 2543

SEQ ID NO: 3140 - DNA, 173 bp, Homo sapiens
aggtaccatgctgacttcttggtatcttttaaggcctaattttcccttccttgagattactgtagtgtgttccagctaatttctatttggaaacgagttggaacagctgaaaactaggtattattgaaggcaaagcagcctcacgtcagttttttatcagctcatttgggaag

SEQ ID NO: 3141 - DNA, 367 bp, Homo sapiens; identical to SEQ ID NO: 428

SEQ ID NO: 3142 - DNA, 322 bp, Homo sapiens
gggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactga

SEQ ID NO: 3143 - DNA, 521 bp, Homo sapiens
tccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccc

SEQ ID NO: 3144 - DNA, 558 bp, Homo sapiens
ggtatcatcagtgagcccctcacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagc

SEQ ID NO: 3145 - DNA, 528 bp, Homo sapiens
gaagtttggcgtggtggtggttggtgttggccgagccggctccgtgcggatgagggacttcgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgacctggctggtctccctctttggggagc

SEQ ID NO: 3146 - DNA, 587 bp, Homo sapiens
agggtcagccatgtcatctgagcctcccccacaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctgg

SEQ ID NO: 3147 - DNA, 314 bp, Homo sapiens
cgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaacc

SEQ ID NO: 3148 - DNA, 674 bp, Homo sapiens
tcccgcttctgggagtggggaaagacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaag

SEQ ID NO: 3149 - DNA, 566 bp, Homo sapiens
ccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcg

SEQ ID NO: 3150 - DNA, 455 bp, Homo sapiens
gtcggtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttt

SEQ ID NO: 3151 - DNA, 409 bp, Homo sapiens
ttccgttgctgtcgaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtc

SEQ ID NO: 3152 - DNA, 559 bp, Homo sapiens
atttgtggaccacgtgtttactttcaccattttggataataggatatggtttcggaactttcagatcatagaagaagatgctgctcttgtagaaataggacctcgttttgtcttaaatctcataaagattttccagggaagtgggggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaataagtcaatggaaacctgatttgtttttcagttactttatatttattttggattcaatgtgtaaatacttttattatctaatactatcttacgtctaatt

SEQ ID NO: 3153 - DNA, 494 bp, Homo sapiens
gctgtcggactggtattcccactagagtaattaatcataaactgggtagagtcggtagaatttgacagtgcaattgacctatccttgaagagttctccatagacatagtctgtcttgcaggattcatgagaattctttctggcccctttgtccaaaagtggaatggaaaaatgctcaatatccacccatccttgctgccttcttttaagggtcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggg

SEQ ID NO: 3154 - DNA, 547 bp, Homo sapiens
attcggcacgagctaagttaatgctttttctcaaggaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgt

SEQ ID NO: 3155 - DNA, 514 bp, Homo sapiens
ttccgttgctgtcggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgct

SEQ ID NO: 3156 - DNA, 417 bp, Homo sapiens
tgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaact

SEQ ID NO: 3157 - DNA, 562 bp, Homo sapiens; identical to SEQ ID NO: 2525

SEQ ID NO: 3158 - DNA, 598 bp, Homo sapiens
agctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacgggtgagtgagtggctgggggggcaccccgcagctcggggggctccgggcggccccaggactcaccagcttcccccgcagcatcatggggctgtacgtgtccatcgtgctggtcatcggcaagtttgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcc

SEQ ID NO: 3159 - DNA, 220 bp, Homo sapiens
gggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctc

SEQ ID NO: 3160 - DNA, 549 bp, Homo sapiens
atgccgccctacccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcc

SEQ ID NO: 3161 - DNA, 504 bp, Homo sapiens
tccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacaaaaaaaaagcctctagaactatagtgagtcgtattacgtagatc

SEQ ID NO: 3162 - DNA, 408 bp, Homo sapiens
ggcacgaggggcgctccgctggcttcttggacaattgcgccatgtgtgctgctcggctagcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctc

SEQ ID NO: 3163 - DNA, 552 bp, Homo sapiens
ataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatata

SEQ ID NO: 3164 - DNA, 456 bp, Homo sapiens
gaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggaggacctgctccagcagctggtgctgcaccagcaggaggtcctgccccctgcactgctgctgctccagttgaggagaagaaagtggaagcatagaaagaagaatccgacgagtctgatgatgacatgggctatggtctttttgactaaacctcttttataacatgttcaataaaaagctgaactttaaaaag

SEQ ID NO: 3165 - DNA, 569 bp, Homo sapiens
ctggcggctggtgcccaagcgacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaagggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaag

SEQ ID NO: 3166 - DNA, 532 bp, Homo sapiens
cgtggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaat

SEQ ID NO: 3167 - DNA, 544 bp, Homo sapiens
ttccgttgctgtcgctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagccttttccatcccagccctgtcagtgagcccaggtctggtgcaactgct

SEQ ID NO: 3168 - DNA, 484 bp, Homo sapiens
ttccgttgctgtcggatgaagcagagccatgactcaggacgcccataatgccttgagaagagtaattgagaaattcacagaaaataccacattctgcctcatttgtaactatctgtcaaagatcatccctgccttgcagtcccgctgcacgaggtttacgttcggtcccctgactcctgaactcatggatccccgcctggaacatgtcgtgcaagaagagaaagttgatataagtgaagatggaatgaacgcacttgtcactctttccagtggagacatgcgtagggctctgaacattttgcagagcaccaatatggtctttgagaaggtgacagaggagactgtctacacctgcaccgagcacccgttcaagtcagacattgccaacatactggactggatgttgaatcaagatttcaccacaccctacagaaatattacagagttgaaaactctgaaggggttggcactgcatgatatcctg

SEQ ID NO: 3169 - DNA, 506 bp, Homo sapiens
cgttgctgtcggggggcaagggagaagctgctggtcggactcacaatgaaaacgctccttcttttgctgctggtgctcctggagctgggagaggcccaaggatcccttcacagatggaatacttcggcactatctccattggctccccaccacagaacttcactgtcatcttcgacactggctcctccaacctctgggtcccctctgtgtactgcactagcccagcctgcagtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaa

SEQ ID NO: 3170 - DNA, 535 bp, Homo sapiens
cgttgctgtcgggcttgggcagcaacccctgcattcctttttttttaccgggctgacgagaatgatgaggtgaaaatcactgtcatctaaaagccggctactgtcagcaaagcctgaagaagtggggctggataccctgcccccaccatatccctaccatcccttctcagacaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggca

SEQ ID NO: 3171 - DNA, 606 bp, Homo sapiens
ttccgttgctgtcggtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttct

SEQ ID NO: 3172 - DNA, 400 bp, Homo sapiens
cgttgctgtcgtcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcagacgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggc

SEQ ID NO: 3173 - DNA, 618 bp, Homo sapiens
ccgttgctgtcggaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaa

SEQ ID NO: 3174 - DNA, 480 bp, Homo sapiens
acccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcat

SEQ ID NO: 3175 - DNA, 528 bp, Homo sapiens
taacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcg

SEQ ID NO: 3176 - DNA, 459 bp, Homo sapiens
gccaaggcccgagggggtgggcgtggcggccgccgaaacacaaccccctctgttccctctcttcgcggagcggcgccgcgtagcttccatccgccagctgccatgagcgagcgcctccgtcccagtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacg

SEQ ID NO: 3177 - DNA, 281 bp, Homo sapiens
tcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttc

SEQ ID NO: 3178 - DNA, 514 bp, Homo sapiens
tcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctg

SEQ ID NO: 3179 - DNA, 564 bp, Homo sapiens
ccagcaggtccctttgccggcccctacggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggc

SEQ ID NO: 3180 - DNA, 604 bp, Homo sapiens
ttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctc

SEQ ID NO: 3181 - DNA, 475 bp, Homo sapiens
gtcgcgtatgtttacattttttattttttccatagggtacttattctcaatttttttggtctcagattcactcttaaaatgaagaccccaaaggtttcttttatttctattattagatatattaaaaattaaagctttagccaggtatagtggcgtgcacctgtagtcccagctattcaagaggctgaggtggggctgggcatggtggcttacacctgtaatcccagcactttgggaggccaaggcaggtggatcacttgaagtcaggattttgagaccaccctggccaacgtggtgaaaccccatctctactaaaaaaattaaaaagtagccaggcatggtggcatgtacctgtagccccagttactcaggaggctgaggcaggaaaatcacttgaacctgggaggcagaggttgcagtgagcccagatcactccactgcactccagcctgggcgacaaagtgagacttgtctc

SEQ ID NO: 3182 - DNA, 658 bp, Homo sapiens
  misc_feature 2, 3, 5, 11, 13, 15, 16, 18, 20, 23, 25, 64, 414, 526, 608: n = A,T,C or G
gnngntttttntncnngngnttnangagatgtttaaaaaaattgttgcatgtttttgatgcagnttgggaaattgtttacttcacaatgtaaaggttcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctnccaaagtgttaggataacaggtgtgagccaccgtgcccggctgaagatttttcttaattgcaataaatattcagcattttttctaatgaaaatgaatttgtttaccagtaanaagtatgcatttttaaaagacttttcagatttatgctttttacgtgaagctgctaaactaaaagtaaatggaagaaaccaantctaagtagggttttttctttttttttgtggggggtgggatgggggaggc

SEQ ID NO: 3183 - DNA, 452 bp, Homo sapiens
tgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggtttttcatgctggatttcttatctgagagaccctggattaaaaggatgatttttaag

SEQ ID NO: 3184 - DNA, 463 bp, Homo sapiens
tccgttgctgtcgagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagt

SEQ ID NO: 3185 - DNA, 532 bp, Homo sapiens
attccgttgctgtcgaagaattcgcggccgcgaattcttccggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtgtgagtgtctacccgcccctctgagcccacagggttcagcttaccccttccctcatgcaacttatatttttttgagtatcttctatgtaccaggcactatgcgaggttttatatcccagtaggatataagctaggtgctggggatgtgacagtgaataaaataggacaaaatccctgccttcccagag

SEQ ID NO: 3186 - DNA, 551 bp, Homo sapiens
cagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatca

SEQ ID NO: 3187 - DNA, 518 bp, Homo sapiens
ttccgttgctgtcggtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatata

SEQ ID NO: 3188 - DNA, 539 bp, Homo sapiens
gtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactaccct

SEQ ID NO: 3189 - DNA, 436 bp, Homo sapiens
gtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggac

SEQ ID NO: 3190 - DNA, 524 bp, Homo sapiens
caagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgc

SEQ ID NO: 3191 - DNA, 367 bp, Homo sapiens
cgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctaca

SEQ ID NO: 3192 - DNA, 572 bp, Homo sapiens
tgttttagttttgcagaagacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactct

SEQ ID NO: 3193 - DNA, 570 bp, Homo sapiens
tcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacct

SEQ ID NO: 3194 - DNA, 530 bp, Homo sapiens
cgttgctgtcgcttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgaccccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcaggagcccctagcattggctgggattcctgttcctgggtgcgcct

SEQ ID NO: 3195 - DNA, 256 bp, Homo sapiens; identical to SEQ ID NO: 463

SEQ ID NO: 3196 - DNA, 343 bp, Homo sapiens
cgcggccgcaggagttttttttttttttttttttaaaaacccaaaaattttttttttaaattcccgggttttaattggaaatcccccttctttaggggccccccttgaaattaaaaatttcttaaaaaggcccttcaaaccccaaaaaaaggggggaaccgggccccatttgggggtttggaaggcttttgccccttcaaaatatttttggaaagggggcccccttttaaggttttttttggaaaagtttttttttccgcccttttttttaaaggttttttttgaccaagggggggttttttttccccccctggggggggggggaccaaaactttttttaaaa

SEQ ID NO: 3197 - DNA, 614 bp, Homo sapiens
ccgttgctgtcgcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtac

SEQ ID NO: 3198 - DNA, 519 bp, Homo sapiens
gtcgacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaagaattttttaattactt

SEQ ID NO: 3199 - DNA, 709 bp, Homo sapiens
  misc_feature 34, 503, 508, 519, 616, 631, 678, 680, 684: n = A,T,C or G
ggcacgagaaaaagcaagccaaaaggaatgctgntttttaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgnagtgnttatgtcttgnttctaaatctcttcatagattccatcaacactccagatttaattatctcctcatagttggtattaagctctttttaatggcttcaactttgtatcantatactggatttatnaactttgtacccacaaggagagaagtgtagcacccattttacagtgncntgcncatcaagagaaagaaactgcatgtt

SEQ ID NO: 3200 - DNA, 450 bp, Homo sapiens
  misc_feature 4, 7, 8, 10, 11, 36, 56, 104, 120, 123, 137, 287, 296, 311,326, 404, 405, 406, 407, 410, 412, 414, 423, 431, 436, 437,442: n = A,T,C or G
gttnccnntnngtgaaactcactgtaaaaccctacngaaaacccttgagcccatcnattcgtttttttttttttttttttgcctctgccctgatcatcattttnctcaaggaaccaccantanacagaaagaaacanaaaaacattaaacacagtgggaatatcacttttgatgagattgtcaacattgctcgacagatgcgggaccgatccttagccagagaactctctggaaccattaaagagatcctggggactgcccagtcagcgggctgtaatggtgatggncgccatccncatgacatcatcgangacatcaacaggggngctggggaatgcccagccaggtaagcacaaaggaaaacatttcaataaaggatcatttgacaactggtgaaaaaaaannnnaanananaatgggganaggcaatnaaaanngcctngccctcta

SEQ ID NO: 3201 - DNA, 540 bp, Homo sapiens
ggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatcaagctagagactgctggcacccc

SEQ ID NO: 3202 - DNA, 749 bp, Homo sapiens
  misc_feature 1, 2, 7, 17, 35, 38, 40, 49, 52, 54, 62, 81, 106, 107, 121,154, 155, 162, 163, 645, 675: n = A,T,C or G
nntctanaatacaaacnacctactcgttctgcagngancnatcccatcnatncnaattccgnaccagagaaatcgcaagcngtatatgtaacagtaatatctgctnnaaatacagaatcanctacttttatacaacttaacaggcaaacatgtnnttttggnnttgttgtttggaaattagcattgggaaaagctatataacagaggaaattccaagtaaaatcaaacagtgttcactcttaactctaaacacagtgctcccactactggttctgcattgaggcggaggggaaggccagaggcaggcttagcttcgggcggcagcggtctggggctgctcggactggagctgcttgccaaggtattcccagttgtgcaccatgagcttctgcacggccagcagagcattatagcggacctgctggtcttcatgatgcatgtggttcatgaccagctgcttcccaccgagctgctcgatgacccgtttgcctcgtggataatgccgcacatattctccaacatcgtgagcagcaacagctaagacttggggatcatctgacacttccaaaagttttgtcaagattttcaagagttcataattcttctcatttaacctcacagcattctctcttcaaaatttctcanatttgtgcacaggactccattccaaccttncagatttaagttctgaactgtattcatcaaatgaactaaggtcctggacactctctccaagttttttcaaaaag

SEQ ID NO: 3203 - DNA, 609 bp, Homo sapiens
ccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagaccagaagtgagactggagggaaagggtagctgagtctgcttaggggactgcatgggaagcacggatat

SEQ ID NO: 3204 - DNA, 536 bp, Homo sapiens
ctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacatt

SEQ ID NO: 3205 - DNA, 559 bp, Homo sapiens
cagaacgtgccaactctatgggcctgtttctgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctcatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacct

SEQ ID NO: 3206 - DNA, 529 bp, Homo sapiens
gctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatattccaaaatgac

SEQ ID NO: 3207 - DNA, 546 bp, Homo sapiens
  misc_feature 457: n = A,T,C or G
ttttatttcctgattttaaaaatcgtcaccatcatagacctcctggcttctcttgtatctgtgttctaatggctcccagcagtgccttcacacagcccctttattccccttcttgtgcctgcccatgagcctgagtgtgacagatcaattagctttgtccctccaaactgtgggagcaggactagactcttctggcaggcagagagctcctcctcggccagtgttcgagcctggtccaccactcctcagttcttcttgctcttggcttttgtggccttggcatccagcgtgctctgggcatgagtgaggtgcttcacagcatcaagcacaaggactccaggcagcaccagccacagggcattcatgaagacaaagtaaaaccagaagtagagagggtggcccagctctccgtgctggaatccgtcgcggtgctctgtcaggaagtagagcacatccncatagatctggcccacagagaccacaagctgtagaatgaagcggaggggatgctggcggagaaaggcgatcaccacccacaggctgagt

SEQ ID NO: 3208 - DNA, 421 bp, Homo sapiens
tggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaa

SEQ ID NO: 3209 - DNA, 512 bp, Homo sapiens
tgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacct

SEQ ID NO: 3210 - DNA, 505 bp, Homo sapiens
  misc_feature 40, 47: n = A,T,C or G
tctgacagctggtgcgcctgcccgggaacatcctcctggnttttttnatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctcctctg

SEQ ID NO: 3211 - DNA, 249 bp, Homo sapiens
tagattgacaagaaagagcccacctgaatgaccttgaaaatattattccatttcttggaattggcatcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagta

SEQ ID NO: 3212 - DNA, 573 bp, Homo sapiens
ttccgttgctgtcgcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctc

SEQ ID NO: 3213 - DNA, 354 bp, Homo sapiens
gctgtcgggtttctgtagaggaatgtcttccaggtgggagaacaatggctttcatttttaacaaccacacactataaacaaagcatcccgagagcacgggtacctagcagaagaagaacgaagtagccaggaaacaagttgcttttcagcatccccactgaaatgatagggtactttataaagcgggtggtggcattctttccacaagtacagcaagtgtcactgtggggtcttaattctctcgaatctgcctttagaaggcagaaggcagaatgatcagctctgctctgaatgtgtttgccatttgattgacgtcggaaacatgatgtcacttctgcaaacacccacgtgaga

SEQ ID NO: 3214 - DNA, 523 bp, Homo sapiens
agtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 3215 - DNA, 539 bp, Homo sapiens
ttccgttgctgtcgggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaat

SEQ ID NO: 3216 - DNA, 471 bp, Homo sapiens
attccgttgctgtcgagaaactaaagatttttttaggagactatattcaagcttgtatcattagttcatcagacgtttatggaccacccaccgtccgtgcactcacggggcttgcagtctatctggctgaatcactttggcagccagtgtgaggagggcacagaaaggagaccaggtgagaaagccagcctgaccaaagaagatgtggcaactgatgggattggaggaggcggacaatgtcctccagacagctggactggctctctatatatttatttatctcttctacacctccagcccccaccttcacactcactaactggactcaactagtgggggcaaaggacagactagattttagtgaaatggaatttctacctccagcggcccctggaacagtagcacacaacgatctaacaactgcttgtatgattggatggtgtaagtgcggacagaattagggaatttggg

SEQ ID NO: 3217 - DNA, 531 bp, Homo sapiens
cgttgctgtcgaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaatactgaagagcaaaagagaggcaggattggggt

SEQ ID NO: 3218 - DNA, 499 bp, Homo sapiens
ttccgttgctgtcgggtgaggcggcccgaaatcgtaggacttccgaaagcagcggtggcgtttgcttcactgcttggaagtgtgagtgcgcgaagatgcgaaaggtggttttgatcaccggggctagcagtggcattggcctggccctctgtaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggact

SEQ ID NO: 3219 - DNA, 400 bp, Homo sapiens
gctgtcggtgaggctctggcctgcactcgcgccgccatggacgctgcgagtcgaattcctcccgagaaggactggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctggtaaatcatgcttcagacaacatcccgaaggcagacgaaatccggaccctggtcaaggatatgtgggacac

SEQ ID NO: 3220 - DNA, 660 bp, Homo sapiens
attccgttgctgtcgagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgac

SEQ ID NO: 3221 - DNA, 533 bp, Homo sapiens
tccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatatagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgca

SEQ ID NO: 3222 - DNA, 542 bp, Homo sapiens
ttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttc

SEQ ID NO: 3223 - DNA, 582 bp, Homo sapiens
ctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatag

SEQ ID NO: 3224 - DNA, 436 bp, Homo sapiens
agtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttataaggcaaaagagggaggagatgcgactcgaagcagaaagaatcgcctaccagaggaatgacgatgatgaagaggaggcagcccgggaacggcgccgtcgagcccgacaggaacagctgcggcagaagcatgaggaagaatccttgggacaggtgaccgaccaggtggaggtgaatgcccacaacagtgtgcctgacgaggaggccaagacaaccaccacaaacact

SEQ ID NO: 3225 - DNA, 291 bp, Homo sapiens
attccgttgctgtcgcgaaatcaagcctttggtcaagctgctggaggacatgccacagatctttggtgagcaggtgtctcggaagcagttttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctgga

SEQ ID NO: 3226 - DNA, 477 bp, Homo sapiens
cttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtgga

SEQ ID NO: 3227 - DNA, 53 bp, Homo sapiens
tactattgatcctgtctttcttttgcaaaaaatgggagtatgcaaacttgaga

SEQ ID NO: 3228 - DNA, 414 bp, Homo sapiens
cacacggcttctcctcccgcctgggcaagcgggtctctgacatcctccgatacctatttcccgtgcccaaagatgacagccaccggggcatcaccttcgcagaccaagacgactacctatcattccggcaccatgtgtctaagatgacagaccaccgcaacgtggagctcactgacgtcgggccccgctttgagctgaagctgtacatgatccgtctgggcacgctggagcaggaggccacatcagacgtggagtggcgctggcacccttacaccaataccgaacgcaagagagtcttcctgagcaccgagtgagcacactcaccactcagctcagacatggacttggaactcatgatggggctgtcatagacagacccaccagtaggaactgtcacagaatggcctgctgaac

SEQ ID NO: 3229 - DNA, 671 bp, Homo sapiens
tgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttatt

SEQ ID NO: 3230 - DNA, 320 bp, Homo sapiens
tccgttgctgtcggtggagggccgcccgaaggcactctcggacattaacccgcattctggtgggtctagaggaaattgggggacgaagagtggcagcactgacctggtctgggacgtggggagaagggtgcgctacctgggtttcaggtgggagggcgttcggtcgggcctccagggggatagcgggggtgcttgagtcgcgggtgctgagtcgggagtgctgagtgagttgcgggtgctgagttgaggctgtgccctttcccactataatacgccaagcgtgcgttctgccgttccctccgacacgcgcgacgccacct

SEQ ID NO: 3231 - DNA, 542 bp, Homo sapiens
tccgttgctgtcgagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttgtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaatt

SEQ ID NO: 3232 - DNA, 550 bp, Homo sapiens; identical to SEQ ID NO: 495

SEQ ID NO: 3233 - DNA, 572 bp, Homo sapiens
  misc_feature 427: n = A,T,C or G
ccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccangacaggatccaggccggcttgccacaccccccacccctaggacttattcccgctgactgagtctctgaggggctaccaggaaagcgcctccaaccctagcaaaagtgcaagatggggagtgagaggctgggaatggaggggcaga

SEQ ID NO: 3234 - DNA, 509 bp, Homo sapiens
  misc_feature 311: n = A,T,C or G
ggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccancaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcaaatggactacctct

SEQ ID NO: 3235 - DNA, 653 bp, Homo sapiens
tccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaagaaagatcccacagtctcagccctgcttactagtgagaa

SEQ ID NO: 3236 - DNA, 586 bp, Homo sapiens
  misc_feature 522: n = A,T,C or G
caatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattacggngttttatgcaaaattccaagctaccatgtaactttttttaaccatttaacaaggagggggaact

SEQ ID NO: 3237 - DNA, 130 bp, Homo sapiens
ttccgttgctgtcggtcttgaactcctgacctcgtgatccacccgccttggctccccaaagtgctggattacagacatgagccactgtactcagccaaagtctttttatataggaatacttttttttttt

SEQ ID NO: 3238 - DNA, 385 bp, Homo sapiens
gggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcg

SEQ ID NO: 3239 - DNA, 560 bp, Homo sapiens
ccgttgctgtcgcttctggttatctgaagactgtcctgaaggaagacataagtgttgtgattagtagaagctttctggtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagt

SEQ ID NO: 3240 - DNA, 626 bp, Homo sapiens
ccgttgctgtcgcttctggttatctgaagactgtcctgaaaggaagacataagtgttgtgattagtagaagctttctggtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactg

SEQ ID NO: 3241 - DNA, 434 bp, Homo sapiens
catcaacatttggcgtgatgtgggcctttgtggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggacccta

SEQ ID NO: 3242 - DNA, 361 bp, Homo sapiens
gcccttagcgtggtcgcggccgaggtacttcttttgaataattcagtattttaaaaatgcaagccaggcacagtggctcacgcctgtaatccagcactttggaaggccgaggtggggggatcacgaggtcaggagttcaagaccagcctggccaacatggtgaaacctcatctctactaaaaatacaaaaactagctgggcatggtggcgggcacctgtaaccccagctacttggagggctgaaggagaattgcttgaatccgggaggcagaagttgcagtgagctgagatggcgcccttgcactccagcctggccaacaagagtgaaactccgtctcaaaaacaaacaagcaaacaaaca

SEQ ID NO: 3243 - DNA, 699 bp, Homo sapiens
  misc_feature 583, 651: n = A,T,C or G
ggtaccatgctgacttcttggtatcttttaaggcctaattttcccttccttgagattactgtagtgtgttccagctaatttctatttggaaacgagttggaacagctgaaaactaggtattattgaaggcaaagtagcctcacgtcagttttttatcagctcatttgggaagttttttttttttttttttttttttttaattaattagaaagtaggctgggtacggtggctcatgcctataatcccagcacttggggaggccgaggatctcctctctggtggatcacttgagggcaggagttaagagaccatcctggccaacatgatgaaaccctgtctctactaaaaatacaaaaagtagctgggcgtggtggcatactcttacaatcccagctacttgggaggctgaggcaggagaatcacttgaacctaggaagcagaggttgcagtgggccaagatcacaccactatactctagcctgggcggcagaggtggggaaaaaagtaggacccctgtcctatattcaggtttttctcacatatatgaacccatctaaattctacgttgttaaaggtagcttangttaattagtctatacttatttaagaccaatatggggtgagatggatttttttttaaaaatcctacantaaggctttctactttccttctaatgaggaaaaaagtggcaaaaattt

SEQ ID NO: 3244 - DNA, 394 bp, Homo sapiens
aggtacactgaaatcaggtaacaaaggcatcttactataacttctttaataaagaagtagagagttaccagtgtaattcaggacaacctactcatttaagtttaaagttttttctttacatcatgcaatatttgacttcaaaaaacattttccattctgtcttctcttatatataaacattaagagctattacaaagttctttcctctaagtaaaaaacccactagaaaaagatatttgtaaaaatcattgcagggttactgatactgaatgaagcacaggggtactaaatttctgaggaattaatactgatgggaaggatgcagtaaagagtaaaaacgggggcattgtggtttatacctgtaatcccaccactttgggaggctggggctgga

SEQ ID NO: 3245 - DNA, 104 bp, Homo sapiens
gcccttagcgtggtcgcggccgaggtacaatcttggctcactgcaacctccacctcccgggttcaagcaatactcctggctcaacctcctgagagctgggacta

SEQ ID NO: 3246 - DNA, 265 bp, Homo sapiens
gcccttagcgtggtcgcggccgaggtacatggaggcctggactgtaaagagactacggaaggggcagcatgtgtgttttgcttctcagattcattgtcactcacgttgcataaagtcctcagttgtttttaagtaattgttttactatggatatattaaacatacagaataaaaaagggaataaacatacaatttggcaaaccccctactgagcctttaaaaatattagaaggttggtattaaaccaggtaacttacggatttgg

SEQ ID NO: 3247 - DNA, 532 bp, Homo sapiens
tcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaatgaaagttctgttcgtttatccattgcgatctggggagccccatctcgatatttccaatcctggctacttttcttagagaaaataagtcctttttttctggccttgctaatggcaacagaagaaaggg

SEQ ID NO: 3248 - DNA, 398 bp, Homo sapiens
ttccgttgctgtcgcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctc

SEQ ID NO: 3249 - DNA, 483 bp, Homo sapiens
ttccgttgctgtcgggaaactgaagctgggggagaccaagtgaccttcccaaggtcataaaatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcaccc

SEQ ID NO: 3250 - DNA, 371 bp, Homo sapiens
attccgttgctgtcgaaatttacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcac

SEQ ID NO: 3251 - DNA, 327 bp, Homo sapiens
agcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacc

SEQ ID NO: 3252 - DNA, 261 bp, Homo sapiens
gtcgtaacaggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcact

SEQ ID NO: 3253 - DNA, 487 bp, Homo sapiens
gtcggtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttgggggccgctggaggccacctgccaaggcgtgggatgggatggtcctgctggtttaggccgtgattctggaaaaccttggatgggccttcgtcctatgtcagccttccctctgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcat

SEQ ID NO: 3254 - DNA, 439 bp, Homo sapiens
aacggagtcccaggacagtgctgagccttctggctcagaggaagagtctgaccctgtttccttggagagggaggacaaagtccctggccctctagagatccccagtgggatggaggatgcaggcccaggggcagacatcattggtgtgtaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaaaacctcttgggcaggggctcctgttcacctgggccagggtcagttcctgaagttcactcagagggaaggagatagagagtcctggtcctcaggggaggactaggaaaagaccatctgcccggcactggggac

SEQ ID NO: 3255 - DNA, 479 bp, Homo sapiens
  misc_feature 113: n = A,T,C or G
ccgttgctgtcgcaagtttgaaaagtgatgacggttgacgtttgctgatttttgactttgcttgtagctgctccccgaactcgccgtcttcctgtcggcggccggcactgtangtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgat

SEQ ID NO: 3256 - DNA, 419 bp, Homo sapiens; identical to SEQ ID NO: 2661

SEQ ID NO: 3257 - DNA, 443 bp, Homo sapiens
gcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgc

SEQ ID NO: 3258 - DNA, 585 bp, Homo sapiens
tccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttc

SEQ ID NO: 3259 - DNA, 363 bp, Homo sapiens
gactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctccttctt

SEQ ID NO: 3260 - DNA, 608 bp, Homo sapiens
tgtgctgtgctcaccagacactttgatcttggacttctcagcctccagaactatggggttctgctcttgtcacccagactggagtgaagtggcacaatctcggctcactgcaacctccgcctcccgggttcaagcgattcccctgcctcagcctccagagtagctggactgcaggcgcacgccaccactcctggctaatttttgtatttttagtagagacggggtttcaccatgttggccaagatgttcttgatcttctcaccttgtgatccgcccacctcaacctcccaaagtgctgagagactaagacacctttctagacagagaggaggccgatggcagacattctcagataggtttgtagctattgacctggctgcatcaaaggagatgaaatcccttagaaattgacagcttctatgaaatttacaatcaagaaggcataagaacaactgctgcagcttcagaactatgcagaaaataaaatgtcaacagctgggagaaaaaattctaagtgagcaacagagccagtgaaaaatatcaccagtagagcaggcacctgagacagggaaatggcacccactaagtgcaggtctacaggggctgac

SEQ ID NO: 3261 - DNA, 455 bp, Homo sapiens
tctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacac

SEQ ID NO: 3262 - DNA, 455 bp, Homo sapiens
gtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaag

SEQ ID NO: 3263 - DNA, 403 bp, Homo sapiens
ttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgag

SEQ ID NO: 3264 - DNA, 212 bp, Homo sapiens
gggggaaaggacctataaactttttaaggtaaaatcaaatatagctactgcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagt

SEQ ID NO: 3265 - DNA, 546 bp, Homo sapiens
tagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctc

SEQ ID NO: 3266 - DNA, 276 bp, Homo sapiens
tggggctcgccctcctgtgcatcgcggctaatattttgctttactttcccaatggggaaacaaagtatgcctccgaaaaccacctcagccgcttcgtgtggttcttttctggcatcgcaagaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctact

SEQ ID NO: 3267 - DNA, 306 bp, Homo sapiens
acattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcaacgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacc

SEQ ID NO: 3268 - DNA, 538 bp, Homo sapiens; identical to SEQ ID NO: 515

SEQ ID NO: 3269 - DNA, 529 bp, Homo sapiens
attccgttgctgtcgcgagttcatccatcaatttcctgactcgagttagtggcattggtccatctgctgcaaggaagtttgtagatgaaggaattaaaacactagaaggctcacagctggattcatgcccagtaaagggacacctgaatggaactgagtcacttttagacttaatatgggatgttatgacaattcttaagttaaaaaatgcagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtc

SEQ ID NO: 3270 - DNA, 447 bp, Homo sapiens
ttgctgtcggtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgag

SEQ ID NO: 3271 - DNA, 528 bp, Homo sapiens
ttccgttgctgtcgggcatttcttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagag

SEQ ID NO: 3272 - DNA, 422 bp, Homo sapiens
ggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttc

SEQ ID NO: 3273 - DNA, 527 bp, Homo sapiens
aagcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggcggtgcgggcggccagacaggcggctgacttcgctctgaaggtggaagtggaatgcagcagcctgcaggaggccgtgcaggcagctgaagctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgaccc

SEQ ID NO: 3274 - DNA, 685 bp, Homo sapiens
ctgtcctggctgccgcccccgacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggcggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaatttt

SEQ ID NO: 3275 - DNA, 255 bp, Homo sapiens
cccaagtagctgggaccacaggcgcccaccaccacgccccagcttaaatttttttgtatttttagtagagatggggtttcacttggtgttagccaggatggtctcgatttcctgacctcgtgatctgcctgcctcggcctcccaaagtgctgggatacaggcgtgagccactgtgcccggcccgtaattattcttttcgtgttaagcaatggtaaaagaactgactgaaaataagaatattaaaaagtttctctg

SEQ ID NO: 3276 - DNA, 503 bp, Homo sapiens
tttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcacc

SEQ ID NO: 3277 - DNA, 315 bp, Homo sapiens
gtcgggtaaacacccgaactggtcaactctcaagagaccatctggttcaggttcctgactgggccagcgagtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccgactgagtttcgggaatgtgactacaacaaattcatgagtgttctggacaccaacaaggactgcgaggtggactttgtggagtatgtgcgctcacttgc

SEQ ID NO: 3278 - DNA, 482 bp, Homo sapiens
ttccgttgctgtcggcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccaggctggagtgcagtggcgcgatctcagctcactgcaagctccgcctcctgggttcacaccattctcttgccctcagcctcccaagtatctgggactacagtcgcccgccaccacgcccgggtaatttttttgtatttttaatagagacggggtttcactttgttagccaggatggtctcaatctcctgacctcatgatccacctgcctcggcctcccaaagtgctgggattacaggca

SEQ ID NO: 3279 - DNA, 227 bp, Homo sapiens
caagatcaccatgattgctgagcctcttgagaagggcctggcagaggacatagagaatgaggtggtccagattacgtggaacaggaagaagctgggagagttcttccagaccaagtacgattgggatctgctggctgtccgttccatctgggcttttggccctgatgcgactggccccaacattctggtggatgatactctgccctctgaggtggacaaggctcttc

SEQ ID NO: 3280 - DNA, 417 bp, Homo sapiens
atgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatat

SEQ ID NO: 3281 - DNA, 519 bp, Homo sapiens
aagcttacattatgaagagcagcatattacagccgtatgggtctacttgacagtaaaatttgaagagcattggaagcctgttgatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgt

SEQ ID NO: 3282 - DNA, 511 bp, Homo sapiens
tccgttgctgtcgggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttctta

SEQ ID NO: 3283 - DNA, 500 bp, Homo sapiens
ttccgttgctgtcgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcaaagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtctt

SEQ ID NO: 3284 - DNA, 503 bp, Homo sapiens
cgttgctgtcggttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcagcctcctgagcagcatgcgcctatagtcccagctgctcaggaggctgaggcatgagaatcgcttgaacctacgaggtggaggttgcattcaactgagatcataccacttcattccagcctgggtgacagagcaagactctgtctc

SEQ ID NO: 3285 - DNA, 591 bp, Homo sapiens
ttccgttgctgtcggcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacac

SEQ ID NO: 3286 - DNA, 358 bp, Homo sapiens
tgtcttaatgctctctatgtgagacagaaatagacgtgaccattagtaatgcaactatttttgtcaaatttagtgggattttttggttgttgtttgttttcttgggttttttttttttaaatgacaaactctaaaaatgtcccaatgtgaaaaaacactttcctgaatgccattactcatgccctcaaagctttcatatttgtagcctactcctgtaaagggtttctcctgtttctagtttctagttggcaaaggtatgccaacaaatctggcaacctggtttttgttactaaaacagcatgtgttttcaggtttcttttttattgtacctaaagcagtctaaattaaaacttattaa

SEQ ID NO: 3287 - DNA, 460 bp, Homo sapiens
ggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactgg

SEQ ID NO: 3288 - DNA, 480 bp, Homo sapiens
ttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaa

SEQ ID NO: 3289 - DNA, 580 bp, Homo sapiens
atgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctag

SEQ ID NO: 3290 - DNA, 499 bp, Homo sapiens
atggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcac

SEQ ID NO: 3291 - DNA, 512 bp, Homo sapiens
ttccgttgctgtcggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgaccccccaagcggggagggccgctgtggccttcttcacagccgcgcagtgcccatggaggcgctgctgccaccttcctctcccaagttctttctccatccctctcctcttcccgccgcgccgctagcccgcc

SEQ ID NO: 3292 - DNA, 269 bp, Homo sapiens
ttcgttgctgtcgggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacc

SEQ ID NO: 3293 - DNA, 356 bp, Homo sapiens
gcccttagcgtggtcgcggccgaggtacttcaaccacccctcctacaaaactctatacccttgtcatattaaaattgtatgttatgccaggcttccctaatacaacaaaatctctgaataaaacctattaaatatacaatttctatcaacatgcctgccacacatgcttaataattgcttagtgaatacaagattaatgcatgagtgcctaagttacttcatctagtataacaaatgacaatatctcatttgtttcccgaagtatccttattccattcaagctctgaagaaagtattaatgatattcgtccttaagtaattttttctgcattcaaatctcaccattcaaatgattt

SEQ ID NO: 3294 - DNA, 399 bp, Homo sapiens
ccagaaggacatcctggagcaggcgcgggccgcggtggacacctactgcagacacaactacggggttgtggagagcttcacagtgcagcggcgagtccaacctaaggtgactgtatatccttcaaagacccagcccctgcagcaccacaacctcctggtctgctctgtgagtggtttctatccaggcagcattgaagtcaggtggttcctgaacggccaggaagagaaggctgggatggtgtccacaggcctgatccagaatggagactggaccttccagaccctggtgatgctggaaacagttcctcgaagtggagaggtttacacctgccaagtggagcacccaagcgtgacaagccctctcacagtggaatggagagcacggtctgaatctgcaca

SEQ ID NO: 3295 - DNA, 522 bp, Homo sapiens
tttctgaatgtaaatgccgttggttgggatttggggacctggaagggaccaaggaccacctgaccccaagctgtcctgcctagcgtccagcgtcttctaggagggtggggtctgcctgtcctggtgtggttggtttggccctgtttgctgtgactaccccccccgctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactggggtgccttcccacaaaactagcctccggctctgggcccgagacagccgcaggccccagccactgaatgata

SEQ ID NO: 3296 - DNA, 300 bp, Homo sapiens
  misc_feature 283: n = A,T,C or G
ctaatgaaaaatcatatagagatgaacttggttttgaaatataatgagtagatacttgcttggctgggatggcaaacaagaaaatgaggagcgactttttgggagccaggaaatcatgactgagaaagatatggaattatttcgtgatatccaagaacaagcactgcaggtaaagttggatattcaggttagacaatcaagcaacttgttcatggctgagaaacagcagattaattacattgtgggttaagcagtaacagcagtttgcctaatctcagaatanttgtggtttgtgtgtat

SEQ ID NO: 3297 - DNA, 363 bp, Homo sapiens
ttccgttgctgtcgattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttccta

SEQ ID NO: 3298 - DNA, 383 bp, Homo sapiens
tacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacaggttgattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgaccc

SEQ ID NO: 3299 - DNA, 382 bp, Homo sapiens
gagtgccctgctctggcctcgcttgttgctcttcggggactccatcacccagttttccttccagcagggtggatggggagcatcgctggctgacaggctggtcagaaaatgtgatgttctgaatcgtggagggtcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgt

SEQ ID NO: 3300 - DNA, 356 bp, Homo sapiens
ttttgcttaagcccctttggaatctcccatttggaggggatttgtaaaggacactcagtccttgaacaggggaatgtggcctcaagtgcacagactagccttagtcatctccagttgaggctgggtatgaggggtacatacttggccctcacaccaggtaggttctgagacacttgaagaagcttgtggctcccaagccacaagtagtcattcttagccttgcttttgtaaagttacgtgacaagttattccatgtgatgcttgtgataattgacaacatatgcatggaaatatccacatgaatttcttacacagattcttaccggatgcctaaattgcatcctgtaacttctgtc

SEQ ID NO: 3301 - DNA, 511 bp, Homo sapiens
gatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttcc

SEQ ID NO: 3302 - DNA, 563 bp, Homo sapiens
tccgttgctgtcgggagcagggttgagcaactggtgcagacagcctagctggactgtgggtgaggcggttcacccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccacaaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggac

SEQ ID NO: 3303 - DNA, 533 bp, Homo sapiens
cagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctccc

SEQ ID NO: 3304 - DNA, 536 bp, Homo sapiens
gttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcact

SEQ ID NO: 3305 - DNA, 572 bp, Homo sapiens; identical to SEQ ID NO: 2538

SEQ ID NO: 3306 - DNA, 534 bp, Homo sapiens; identical to SEQ ID NO: 537

SEQ ID NO: 3307 - DNA, 346 bp, Homo sapiens
tgaaaacaacttaaatttttagacaaatgattttagtatataaatttgcttttgtttttatacagaatataaagatttccctcattaatcttccatgtgaagggtattacaagcctggaggaagatactttctgcacacaagtatgtatcttatgtgtgcagtattggaaaccaatggtgtagtgctcctacacataaatggggtcaagtgacatcacaaattaaaagggggaaagagaaatattctagttaatcagatgcaagaagcaaacaagacgcaaaaactgtgcaaataagaccaagccagtaactttagttacgacactgcagattacactggaataac

SEQ ID NO: 3308 - DNA, 485 bp, Homo sapiens
acagcttgactacatgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttc

SEQ ID NO: 3309 - DNA, 586 bp, Homo sapiens
atggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgaga

SEQ ID NO: 3310 - DNA, 583 bp, Homo sapiens
tctcagcataggtatgcttactatgaccttccaagtttgacttgtataacatcactgtcaaactttgtcaccctaacttcgtattttttgatacgcactttgcaggatgacctcagggctatgtggattgagtaatgggattcgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcata

SEQ ID NO: 3311 - DNA, 523 bp, Homo sapiens
  misc_feature 519, 520, 521, 523: n = A,T,C or G
ggcacgaggtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaagaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgttnnnan

SEQ ID NO: 3312 - DNA, 622 bp, Homo sapiens
tgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagacatcctaataagtaacatacccaaaatgctctgtcttgagtcatgagaaccatcagttcttgatattgtctagacttgcatctagagctacgttgtaaaattctt

SEQ ID NO: 3313 - DNA, 211 bp, Homo sapiens; identical to SEQ ID NO: 540

SEQ ID NO: 3314 - DNA, 500 bp, Homo sapiens
ggcacgagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccagaaaaggtgttggttgatatagacagcaggacggtagccaaggaagccgcagaacaggatgttgaaaagaaaaaataaagccctcctggggacttggaatcaaaaaaaaaaa

SEQ ID NO: 3315 - DNA, 425 bp, Homo sapiens
ggcacgaggcagcgtccaaggcttcctgaatttcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgc

SEQ ID NO: 3316 - DNA, 504 bp, Homo sapiens; identical to SEQ ID NO: 542

SEQ ID NO: 3317 - DNA, 300 bp, Homo sapiens
aacattgccttaattgacaggcatcgtgacccagatagttcttaatcattgaaacctgtttctctcctccttatccactggctgcctgggatttgttacctgggaagcagactaccatagcagttaagagcatgagcctaggagtcagacagaccttactttaaagccaggctcttggccaggcacggtggctcatgcttgtaatgccagcactttggaaggccgaggcaggtggatcatgaggtcaggagttcaagaccagcctggccagcatggtgaaatcctatctctaccaaaaat

SEQ ID NO: 3318 - DNA, 284 bp, Homo sapiens
  misc_feature 52: n = A,T,C or G
aatttttgccatcatggctcggttctatacttacatcaacccagcggagatncgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattggatggcccctgatgaggaagacttcagaattgggaactaaaccatgaatgctattttct

SEQ ID NO: 3319 - DNA, 422 bp, Homo sapiens
acacacccatcctggtagacggcaaggatgtgatgccaggagtcaacaaggttctggacaacatgaagtctttctgccagcgtgtccggagcggtgactggaaggggtacacaggcaagaccatcacggacgtcatcaacattggcattggcggctccgacctgggacccctcatggtgactgaagcccttaaggcgtactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctact

SEQ ID NO: 3320 - DNA, 575 bp, Homo sapiens; identical to SEQ ID NO: 550

SEQ ID NO: 3321 - DNA, 596 bp, Homo sapiens
ctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctc

SEQ ID NO: 3322 - DNA, 664 bp, Homo sapiens; identical to SEQ ID NO: 551

SEQ ID NO: 3323 - DNA, 529 bp, Homo sapiens
ttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctggg

SEQ ID NO: 3324 - DNA, 553 bp, Homo sapiens; identical to SEQ ID NO: 553

SEQ ID NO: 3325 - DNA, 570 bp, Homo sapiens; identical to SEQ ID NO: 2871

SEQ ID NO: 3326 - DNA, 447 bp, Homo sapiens
tcggctcgagggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtgggg

SEQ ID NO: 3327 - DNA, 377 bp, Homo sapiens
atgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctc

SEQ ID NO: 3328 - DNA, 550 bp, Homo sapiens
taccacgaagttatggaagaattgctgacaccatggtacaaatattcaaaggacttcaagaaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgg

SEQ ID NO: 3329 - DNA, 481 bp, Homo sapiens; identical to SEQ ID NO: 558

SEQ ID NO: 3330 - DNA, 509 bp, Homo sapiens
aacccttttccattgaggaggtggaggttgcacctcctaaggcccatgaagttcgtattaagatggtggctgtaggaatctgtggcacagatgaccacgtggttagtggtaccatggtgaccccacttcctgtgattttaggccatgaggcagccggcatcgtggagagtgttggagaaggggtgactacagtcaaaccaggtgataaagtcatcccactcgctattcctcagtgtggaaaatgcagaatttgtaaaaacccggagagcaactactgcttgaaaaacgatgtaagcaatcctcaggggaccctgcaggatggcaccagcaggttcacctgcaggaggaagcccatccaccacttccttggcatcagcaccttctcacagtacacagtggtggatgaaaatgcagtagccaaaattgatgcagcctcgcctctagagaaagtctgtctcattggctgtggattttcaactggttatgggtctgcagtcattgttgccaag

SEQ ID NO: 3331 - DNA, 593 bp, Homo sapiens
gtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 3332 - DNA, 537 bp, Homo sapiens
ggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgag

SEQ ID NO: 3333 - DNA, 547 bp, Homo sapiens
  misc_feature 123: n = A,T,C or G
ctggtgtcgccatgggccgccgccccgcccgttgttaccggtattgtaagaacaagccgtacccaaagtctcgcttctgccgaggtgtccctgatgccaagattcgcatttttgacctggggncggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaaatggggcttcaccaagttcaatgctg

SEQ ID NO: 3334 - DNA, 273 bp, Homo sapiens
tcctctcaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttc

SEQ ID NO: 3335 - DNA, 408 bp, Homo sapiens; identical to SEQ ID NO: 2663

SEQ ID NO: 3336 - DNA, 562 bp, Homo sapiens
gtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgc

SEQ ID NO: 3337 - DNA, 513 bp, Homo sapiens
ccttctgacccgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctg

SEQ ID NO: 3338 - DNA, 456 bp, Homo sapiens
tggttgctggggaagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgt

SEQ ID NO: 3339 - DNA, 507 bp, Homo sapiens
  misc_feature 352: n = A,T,C or G
tgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtancagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgact

SEQ ID NO: 3340 - DNA, 509 bp, Homo sapiens
tcggctcgagggaggctctcgtgaactagaccgggcatccgaggtggagagctctttctgacagtgctgcttaatccgatcagcatctttatgacccatctgtccaattatggaaatgaccggctgggctatacacctttgagagcttggtgctcttcctccagtgttggacacggctgcgcctacagacccttcctcctgtcccacttgcacagaagtactttgaacttttccctcaggagcgaccgccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaaggggatgtgactggcacatggatttcttccctgttccttcc

SEQ ID NO: 3341 - DNA, 359 bp, Homo sapiens
cggcagggggaacccagggagcgcgatgggctgcagggctgcgtcagggctcctgccaggagtggccgtggtcctcctgctgctgctgcagagcacacagtcagtctacatccagtaccaaggcttccgggtccagctggaatccatgaagaagctgagtgacctggaggcacagtgggcacccagcccccgcctgcaggcccagagcctcctgcccgccgtgtgccaccaccctgctctgcctcaggaccttcagcctgtctgcgcctcgcaggaggcttccagcatcttcaagaccctgaggaccatcgctaacgacgactgtgagctgtgtgtgaacgttgcgtgtaccggctgcc

SEQ ID NO: 3342 - DNA, 310 bp, Homo sapiens
ggtggcgctgagcaaccgcatgcccatgacaggcctcctgctcatgatcctgagcctcatctacctgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatactagttcttttggggctcccgggccagccgcgaaatcaccaagatgcaaatcatggagttcctggccagg

SEQ ID NO: 3343 - DNA, 509 bp, Homo sapiens
aaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcat

SEQ ID NO: 3344 - DNA, 535 bp, Homo sapiens
tgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaaatgtaattcagtgtaagatgaaaatttatcaatacttatgaaattaggc

SEQ ID NO: 3345 - DNA, 434 bp, Homo sapiens
agctgaaaaagatggaatgcttgcagagcatgacctgaggagggaggaacgtggtcaactcacacctgcctcttcctgcagcctcacctctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgatatagagtggaatctcttggatgcagcttcaagaataaatttttcttctcttttcag

SEQ ID NO: 3346 - DNA, 596 bp, Homo sapiens; identical to SEQ ID NO: 567

SEQ ID NO: 3347 - DNA, 599 bp, Homo sapiens; identical to SEQ ID NO: 569

SEQ ID NO: 3348 - DNA, 494 bp, Homo sapiens
ttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtc

SEQ ID NO: 3349 - DNA, 509 bp, Homo sapiens; identical to SEQ ID NO: 570

SEQ ID NO: 3350 - DNA, 251 bp, Homo sapiens
accatctcaaaaaaataaaataaaataaaatggaagagattccaagattcacctcatttagggatggagctattattataatcagatttctgaaatgagtgctgacttcctctcacatttcacaggaagctagacttcttaaagcttgaagtctccttggtgggttttatttaaattgaattaaaataattattttacagggaaaaatttcaaaacactttgcaactttggggtaaaagttaaataaaaca

SEQ ID NO: 3351 - DNA, 284 bp, Homo sapiens
  misc_feature 97: n = A,T,C or G
cgccgagcgatgggcatctctcgggacaactggcacaagcgccgcaaaaccgggggcaagagaaagccctaccacaagaagcggaagtatgagttgnggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcg

SEQ ID NO: 3352 - DNA, 513 bp, Homo sapiens
cccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaagattttcagagctttgggcactcccaataatgaagtgtggccagaagtggaatctttacaggactataagaatacatttcccaaatggaaaccaagaagcctagcatcccatgtcaaaaacttggatgaaaatggcttggatttgctct

SEQ ID NO: 3353 - DNA, 467 bp, Homo sapiens
gactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagtgttcacgccccgcgtcatcggcacagctgtggccaggtataactttgccgcccgagatatgagggagctttcgctgcgggagggtgacgtggtgaggatctacagccgcatcggcgg

SEQ ID NO: 3354 - DNA, 497 bp, Homo sapiens
gcaccagctgaagatgcacctgctgacgcacagcagcagccagggccagaggcccttcaaatgccccctgggtggctgcggctggaccttcaccacctcttacaagctcaagaggcacctgcagtcgcacgataaactgcggcccttcggctgccctgcggagggctgtggcaagagcttcaccaccgtgtacaacctcaaggcgcacatgaagggccatgagcaggagaactcgttcaaatgtgaggtgtgcgaggagagcttccccacgcaggccaaactcggcgcccaccagcgcagccacttcgaacccgagaggccttaccagtgcgcgttttctggctgcaagaagacatttatcacagtgagtgctctgttttcccataaccgcgcccatttcagggaacaggaactgttttcctgctctttccctggctgcagcaagcaatatgacaaggcttgtaggctgaaaattcacctgcggagtcacaccggcg

SEQ ID NO: 3355 - DNA, 541 bp, Homo sapiens; identical to SEQ ID NO: 575

SEQ ID NO: 3356 - DNA, 383 bp, Homo sapiens
gtcggtatgctctggcatcccatactcttttgggggcaggggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaactagcagaaggccctggcgactgggctgagcccccaagtgaaactgaagttcaggagaccggcctgttcctgagtttgactctattgccaccatcctcacgagactctggtgccccccatgctcccagacctttgagcaaccttcaccgcacaga

SEQ ID NO: 3357 - DNA, 552 bp, Homo sapiens
aagctcggaattcggctcgagcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatg

SEQ ID NO: 3358 - DNA, 561 bp, Homo sapiens; identical to SEQ ID NO: 576

SEQ ID NO: 3359 - DNA, 543 bp, Homo sapiens
taagctcggaattcggctcgagcagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaac

SEQ ID NO: 3360 - DNA, 528 bp, Homo sapiens
tacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttc

SEQ ID NO: 3361 - DNA, 485 bp, Homo sapiens
  misc_feature 84: n = A,T,C or G
tcccatgcttcctgcctctgtgtgcatgtccgttccgaggaatgggatttaatgacctttgatgccaacccatatgacagcgtngaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattg

SEQ ID NO: 3362 - DNA, 593 bp, Homo sapiens; identical to SEQ ID NO: 583

SEQ ID NO: 3363 - DNA, 311 bp, Homo sapiens
taagctcgggattcggctcgaaattaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgataccc

SEQ ID NO: 3364 - DNA, 559 bp, Homo sapiens
cgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggctttttgtcctcctgggtcagggagaacgcggggaccccagaaaggtcagccttcctgaagatgggcaacccccaggtctgcagctccaggtacatatcacgcgcacagcctggcagcctggccctc

SEQ ID NO: 3365 - DNA, 586 bp, Homo sapiens
ggaattcgaattcccgatggaggtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacaca

SEQ ID NO: 3366 - DNA, 592 bp, Homo sapiens; identical to SEQ ID NO: 2633

SEQ ID NO: 3367 - DNA, 575 bp, Homo sapiens; identical to SEQ ID NO: 585

SEQ ID NO: 3368 - DNA, 590 bp, Homo sapiens; identical to SEQ ID NO: 586

SEQ ID NO: 3369 - DNA, 511 bp, Homo sapiens
agctcgggattcggctcgagccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttgg

SEQ ID NO: 3370 - DNA, 525 bp, Homo sapiens; identical to SEQ ID NO: 2745

SEQ ID NO: 3371 - DNA, 553 bp, Homo sapiens
cgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaagacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgag

SEQ ID NO: 3372 - DNA, 401 bp, Homo sapiens
ccgtgcgttgcgttccaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagt

SEQ ID NO: 3373 - DNA, 595 bp, Homo sapiens
taagctcgggattcggctcgagcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgcaa

SEQ ID NO: 3374 - DNA, 529 bp, Homo sapiens
ccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggggtgggcatgggcatgtacaacaccga

SEQ ID NO: 3375 - DNA, 517 bp, Homo sapiens
ctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagactcagtgacagccagagaatgcccactgcctgtaacagccacctggagaacttcataaagatgtctcacagccctggggacacctgcccagtgggccccagccctacagggactgggcaaagaatgatgtttccagattacactccagcctgagtcagcacccctcctagcaacctgcc

SEQ ID NO: 3376 - DNA, 644 bp, Homo sapiens
caaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcct

SEQ ID NO: 3377 - DNA, 559 bp, Homo sapiens
cgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatggga

SEQ ID NO: 3378 - DNA, 376 bp, Homo sapiens
ccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagc

SEQ ID NO: 3379 - DNA, 515 bp, Homo sapiens
tgccaagtggagcacccaagcgtaacgagccctctcacagtggaatggagtgcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggaaaa

SEQ ID NO: 3380 - DNA, 320 bp, Homo sapiens; identical to SEQ ID NO: 597

SEQ ID NO: 3381 - DNA, 469 bp, Homo sapiens
gacactgactgggcccatcaggacagtgctcaggctggagaagtggatcacaccttgttgggacaatgcacaggtgccggctacttcatgcagttcagcaccagctcggggtccgcggaagaggcagccctactggagtctcggattctttacccaaagaggaagcagcagtgcctgcaatttttctataaaatgacgggaagtccttcagacagactcgttgtctgggtcaggagggatgacagcacaggcaatgttcgcaagttggtgaaggtgcagacttttcaaggagatgatgaccacaattggaaaattgcccatgtggtgctcaaagaggaacagaagtttcgctaccttttccagggcacaaaaggcgaccctcagaactcaactgggggaatttacctagatgacatcactctgacagaaaccccctgccccacaggggtctggacagtccggaatttct

SEQ ID NO: 3382 - DNA, 660 bp, Homo sapiens; identical to SEQ ID NO: 600

SEQ ID NO: 3383 - DNA, 494 bp, Homo sapiens; identical to SEQ ID NO: 601

SEQ ID NO: 3384 - DNA, 559 bp, Homo sapiens
  misc_feature 500: n = A,T,C or G
taagctcggaattcggctcgaggacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatntgacagaccccatctccaaggaacggctgagctacaaggaggccatgggccgctgccgc

SEQ ID NO: 3385 - DNA, 177 bp, Homo sapiens
aaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacactt

SEQ ID NO: 3386 - DNA, 505 bp, Homo sapiens
  misc_feature 379: n = A,T,C or G
gttgatttgcctcttaagcaagagattcattgcagctcagcatggctcagaccagctcatacttcatgctgatctcctgcctgatgtttctgtctcagagccaaggccaagaggcccagacagagttgcccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcctggnagccagtgggtcccctggtctcctacaagtcctgggggcattggagccccaagcagtgttaatcctggctactgtgtgagcctgacctcaagcacaggattccagaaatggaaaggatgtgccttg

SEQ ID NO: 3387 - DNA, 447 bp, Homo sapiens
gaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttat

SEQ ID NO: 3388 - DNA, 567 bp, Homo sapiens; identical to SEQ ID NO: 603

SEQ ID NO: 3389 - DNA, 567 bp, Homo sapiens
aggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatgtcccaggtgtgtgatggcggctgcaatct

SEQ ID NO: 3390 - DNA, 569 bp, Homo sapiens
  misc_feature 528: n = A,T,C or G
aactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaanaaagtttacaacataatctagtttacagaaaaatcttgtgc

SEQ ID NO: 3391 - DNA, 501 bp, Homo sapiens
agtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatctt

SEQ ID NO: 3392 - DNA, 525 bp, Homo sapiens; identical to SEQ ID NO: 611

SEQ ID NO: 3393 - DNA, 73 bp, Homo sapiens
cctccacctgctgctgctgggggccgccctgccctgggcatccaagggggtcagtccgagtgcctcatcctgg

SEQ ID NO: 3394 - DNA, 570 bp, Homo sapiens; identical to SEQ ID NO: 2559

SEQ ID NO: 3395 - DNA, 476 bp, Homo sapiens; identical to SEQ ID NO: 613

SEQ ID NO: 3396 - DNA, 246 bp, Homo sapiens
ctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacc

SEQ ID NO: 3397 - DNA, 556 bp, Homo sapiens; identical to SEQ ID NO: 617

SEQ ID NO: 3398 - DNA, 470 bp, Homo sapiens; identical to SEQ ID NO: 622

SEQ ID NO: 3399 - DNA, 254 bp, Homo sapiens
cggctcgagctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaa

SEQ ID NO: 3400 - DNA, 514 bp, Homo sapiens
ccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttt

SEQ ID NO: 3401 - DNA, 288 bp, Homo sapiens
gtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatc

SEQ ID NO: 3402 - DNA, 521 bp, Homo sapiens; identical to SEQ ID NO: 624

SEQ ID NO: 3403 - DNA, 435 bp, Homo sapiens
gggttgaggacatccagaggccattgacctggcggagaagagcagcagccccgcccctgagttcctggccagcagcccccctgacaacaagtcccctgatgaagccaccgcggctgaccaggagtcataggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcataagctgtgggtggtgttcacaaacttctgcctgttcttctacaaatcacaccaggacaatcatccccttgccagcctgcctctgctcggctactcgctcaccatcccctctgagtccgagaacat

SEQ ID NO: 3404 - DNA, 509 bp, Homo sapiens
acgcagctgctgcatggaatcttttcatgtcccggccagaggataacttcttaattaaccttgaccatgtggaatttaagcatttccgtttccttgtcattgaagcaattttggccactgacctgaagaaacactttgacttcgtagccaaatttaatggcaaggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactggtgac

SEQ ID NO: 3405 - DNA, 458 bp, Homo sapiens
ccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggccc

SEQ ID NO: 3406 - DNA, 580 bp, Homo sapiens; identical to SEQ ID NO: 628

SEQ ID NO: 3407 - DNA, 584 bp, Homo sapiens; identical to SEQ ID NO: 629

SEQ ID NO: 3408 - DNA, 477 bp, Homo sapiens; identical to SEQ ID NO: 633

SEQ ID NO: 3409 - DNA, 384 bp, Homo sapiens
taatttcaatctttttcttgaatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcaccagc

SEQ ID NO: 3410 - DNA, 371 bp, Homo sapiens
gtaagctcgggaattcggctcgaggccgccgccatgatcatccctgtacgctgcttcacttgtggcaagatcgtcggcaacaagtgggaggcttacctggggctgctgcaggccgagtacaccgagggggacgcgctggatgccctgggcctgaagcgctactgctgccgccggatgctgctggcccacgtggacctgatcgagaagctgctcaattatgcacccctggagaagtgaccacgctgaaacccacccacccgctgtgctgaccatgggccctgagcgtcctaccccgaattcacgaggctgaggcatccgggagctggcgtaatgcctggccgcagtgtgtgtgtatcccataccccactctg

SEQ ID NO: 3411 - DNA, 501 bp, Homo sapiens
tccaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggag

SEQ ID NO: 3412 - DNA, 438 bp, Homo sapiens
ggcgctgtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgct

SEQ ID NO: 3413 - DNA, 438 bp, Homo sapiens
gagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggag

SEQ ID NO: 3414 - DNA, 509 bp, Homo sapiens
taaatagagcaaatgtaaacaaaagtgcatttttgtattcttgttaattttagatgctttcctagcttacaaaaagttctatttttgggttaaaaatcaatcaactttctgatatttccccttctgcaatgttattgttcataagaaaacacgagctgaaaatggaaatctgcagttgtttcagttgtcttgaatttctttcagtggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgactt

SEQ ID NO: 3415 - DNA, 562 bp, Homo sapiens; identical to SEQ ID NO: 634

SEQ ID NO: 3416 - DNA, 597 bp, Homo sapiens
gaatggaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaaattttaaagacccctaaccctttgtgtgctctccattctgctccttccccatcgttgccccca

SEQ ID NO: 3417 - DNA, 425 bp, Homo sapiens
aagctcggaattcggctcgaggcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtacgggccctttgtgtcctgtaactttttttacctatcaatatgagttgctgtgcttcagtgtgtgttttttaagttgctgggcattacacttaccaattaaagaattttggaaatt

SEQ ID NO: 3418 - DNA, 623 bp, Homo sapiens
taagctcgggattcggctcgagctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgca

SEQ ID NO: 3419 - DNA, 516 bp, Homo sapiens
gtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactca

SEQ ID NO: 3420 - DNA, 507 bp, Homo sapiens; identical to SEQ ID NO: 645

SEQ ID NO: 3421 - DNA, 249 bp, Homo sapiens
aagctcgggaattcggctcgaaaaaggacttgtcctaactggtttgaggccttacagttttgtatctacatttttcccctcctggggtttgcggggacagggacagaactacaggagtcatgggaaagaaaattctggcttcactactgctcactgctcactttctgatcactctgatacttttttttttttttttttgccccccgaccccctaaaaaacctttttggggccccccttttgggccccgg

SEQ ID NO: 3422 - DNA, 475 bp, Homo sapiens; identical to SEQ ID NO: 653

SEQ ID NO: 3423 - DNA, 477 bp, Homo sapiens
gaatgcacaaaaataatacaaccttaaaaatcagactagaagatggaatataagtggtttccttgtaatttttttttaagcttggagaggtaataacacatctttgaattcaaactgaggactgctgcttaatggtgcttttacagggtggttctaaaatttttgagagtcaggtattgctttctctgactgtttaattcaccactggcacgtgtttcctatcctcaagcataagtttaaaagattacaaacctcatgctgctcagttttttctttccagtaaatcagatgcatggtttctctagatttacatatagaaaatcgagatgtggtgggtattagactaacacttcagtgataggaagaagagactgatttctcatatttgtgtaaaacattctcttacctaactaccatctggtccacattaatttcctctcatagccatagctttccattaccaatgagttttccatg

SEQ ID NO: 3424 - DNA, 607 bp, Homo sapiens
tcgactactgtgccctgcgacgctgcgctgatgaccagccgccatcaatcctggacccccccagaccaggtgcagtttgagaagtgtggcaagagggtggatcggctggatcagcgttgttccaagctgcgcgtggctgggggccatccgggcaactcaccctggacagtcagcttgcggaattggcagggccagcatttctgcggggggtctctagtgaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcggg

SEQ ID NO: 3425 - DNA, 572 bp, Homo sapiens
tgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatcta

SEQ ID NO: 3426 - DNA, 357 bp, Homo sapiens
gacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagt

SEQ ID NO: 3427 - DNA, 574 bp, Homo sapiens
gaattcagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctga

SEQ ID NO: 3428 - DNA, 486 bp, Homo sapiens
ttattttatttttaagctcaaactgcttaagataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtgagaatgagatggtgatcatgagacctggaaacaaatatgagtacaagttcggctttgagcttcctcaggggcctctgggaacatccttca

SEQ ID NO: 3429 - DNA, 567 bp, Homo sapiens
cacccaggaaaggaggaccagtcaggatgaggccccgccttttcccccaccctccactgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttcta

SEQ ID NO: 3430 - DNA, 342 bp, Homo sapiens
cgggaattcgaattccaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataat

SEQ ID NO: 3431 - DNA, 497 bp, Homo sapiens
ccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaat

SEQ ID NO: 3432 - DNA, 471 bp, Homo sapiens
aagtactcaccagcctcctggtctgcagagaagacagaatcaatatgagcacagcaggtaaaagtaatcaaatgcaaagcagctgtgctatgggagttaaagaaacccttttccattgaggaggtagaggttgcacctcctaaggctcatgaagttcgcattaagatggtggctgcaggaatctgtcgttcagatgagcatgtggttagtggcaacctggtgaccccccttcctgtgattttaggccatgaggcagccggcatcgtggaaagtgttggagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtc

SEQ ID NO: 3433 - DNA, 513 bp, Homo sapiens; identical to SEQ ID NO: 661

SEQ ID NO: 3434 - DNA, 456 bp, Homo sapiens
tcggctcggggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctc

SEQ ID NO: 3435 - DNA, 399 bp, Homo sapiens; identical to SEQ ID NO: 662

SEQ ID NO: 3436 - DNA, 219 bp, Homo sapiens
agcacagtaaatgttagcatatttatttaaatagtcctgcagcagagaccctgcgattgtaaagtgatttaagtatttctgggtagtgtttgtgatttacggatttgttactgaaaaacaaaaaaaatcactactgtgaatttactactatgtaaccttgtggtcgtatttcattataaataaaataagaattgctcttctgccaaaaaaaaaaacccc

SEQ ID NO: 3437 - DNA, 537 bp, Homo sapiens
taagctcgggattcggctcgaggcgtgggaaaaaggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgc

SEQ ID NO: 3438 - DNA, 538 bp, Homo sapiens
taagctcggaattcggctcgaggcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactga

SEQ ID NO: 3439 - DNA, 466 bp, Homo sapiens
taagctcggaattcggtcgaggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcg

SEQ ID NO: 3440 - DNA, 502 bp, Homo sapiens
taagctcggaattcggctcgaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggc

SEQ ID NO: 3441 - DNA, 465 bp, Homo sapiens
agctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctcca

SEQ ID NO: 3442 - DNA, 492 bp, Homo sapiens
ggctcgagccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttatt

SEQ ID NO: 3443 - DNA, 566 bp, Homo sapiens
ccctttgtcttggagtagaatactaagttagagttagtggatttctagtttaggagaggagctcaaaactatatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgccc

SEQ ID NO: 3444 - DNA, 528 bp, Homo sapiens
gctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttcc

SEQ ID NO: 3445 - DNA, 496 bp, Homo sapiens
ccttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatg

SEQ ID NO: 3446 - DNA, 271 bp, Homo sapiens
gaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacg

SEQ ID NO: 3447 - DNA, 538 bp, Homo sapiens
ggctcgagggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggt

SEQ ID NO: 3448 - DNA, 479 bp, Homo sapiens
tttggtccgcacgcctcctgctcctgactcaccgctgttcgctctcgccgaggaacaagtcggtcaggaagcccgcgcgcaacagccatggcttttaagggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgagggtggaagtcaccattgcagatgcttaagtcaactattttaataaattgatgaccagt

SEQ ID NO: 3449 - DNA, 502 bp, Homo sapiens; identical to SEQ ID NO: 672

SEQ ID NO: 3450 - DNA, 599 bp, Homo sapiens
taagctcggaattcggctcgagtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccaggtctgtccctgctctattctgctccctgctccctgtccaggaaccacacttcgggatccctatcccaaccacccaggtgccctct

SEQ ID NO: 3451 - DNA, 371 bp, Homo sapiens
  misc_feature 264: n = A,T,C or G
tgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcggggggtgtcatctacctggtcactattacagctgcncggtgtggaccatcgagtcatcttgggcaatgaactgccaaaattctatgatgagtgaaccttccccagacttctctttcttattttgtaataaactctctagggcc

SEQ ID NO: 3452 - DNA, 517 bp, Homo sapiens
gggtgctcacagctgctcattgcatcagcgacaattaccagctctggctgggtcgccacaacttgtttgacgacgaaaaaacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccacccaggaacccgaagtggggagcacctgtttggcttccggctggggcagcatcgaaccagagaatttctcatttccagatgatctccagtgtgtggacctcaaaatcctgcctaatgatgagtgcgaaaaagcccacgtccagaaggtgacagacttcatgctgtgtgtcggacacctggaaggtggcaaagacacctgtgtgggtgattcagggggcccgctgatgtgtgaatggtgtgctccaaagtgtcacatcatggg

SEQ ID NO: 3453 - DNA, 612 bp, Homo sapiens
gtttgagagacagactgcagttctgcagcaacaggtcacagtgaatactgaagaattaaaaggaactgaggttcaactaacggagctgagacgcacctcccagagccttgagatagaactccagtcccatctcagcatgaaagagtctttggagcacactctagaggagaccaaggcccgttacagcagccagttagccaacctccagtcgctgttgagctctctggaggcccaactgatgcagattcggagtaacatggaacgccagaacaacaaataccatatccttcttgacataaagactcgacttgaacaggaaattgctacttaccgccgccttctggaaggagaagacgtaaaaactacagaatatcagttaagcaccctggaagagagagatataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgatt

SEQ ID NO: 3454 - DNA, 536 bp, Homo sapiens
ctgcgtggcgtggtacaggagctgcagcaggccatctccaagctggaggcccggctgaacgtgctggagaagagctcgcctggccaccgggccacggccccacagacccagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 3455 - DNA, 509 bp, Homo sapiens; identical to SEQ ID NO: 674

SEQ ID NO: 3456 - DNA, 243 bp, Homo sapiens
aaatgacctctagtgttccccttgggtttaaatgtctataaatgttcaatgactagaatgtattgcgtttttctttattctttttgctttgagaaaagagaatgtgatttaagagtaataatttgaataccaattatccacattaaaattgtgtcctctatgtgtaaggcatagcacatttagcacacatacataagcacactaagcaccttacaaatatcctcatttattctttacataatt

SEQ ID NO: 3457 - DNA, 453 bp, Homo sapiens; identical to SEQ ID NO: 677

SEQ ID NO: 3458 - DNA, 558 bp, Homo sapiens
gggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttca

SEQ ID NO: 3459 - DNA, 612 bp, Homo sapiens
taagctcggaattcggctcgagcgaccttaacaacccggacaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaagcaccagcgtccctg

SEQ ID NO: 3460 - DNA, 444 bp, Homo sapiens
aattcggctcgagcgtggctgtctcctctctccgccatggcgtgtgctcgcccactgatatcggtgtactccgaaagggggagtcatctggcaaaaatgtcactttgcctgctgtattcaaggctcctattcgaccagatattgtgaactttgttcacaccaacttgcgcaaaaacaacagacaaccctatgctgtcagtgaattagcaggtcatcagactagtgctgagtcttggggtactggcatagctgtggctcgaattcccagagttcgaggtggtgggactcaccgctctggccagggtgcttttggaaacatgtgtcgtggaggccgaatgtttgcaccaaccaaaacctggcgccgttggcatcgtatagtgaacacaacccaaaaacgatacgccatctgttctgccctggctgcctcaaccctaccagcactgg

SEQ ID NO: 3461 - DNA, 576 bp, Homo sapiens
tatcaccggaaccgggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaactggacggtgccgcgctcttccagtgcgtggccgcagtgttcattgcacagctca

SEQ ID NO: 3462 - DNA, 559 bp, Homo sapiens
tggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgcc

SEQ ID NO: 3463 - DNA, 238 bp, Homo sapiens
gcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacac

SEQ ID NO: 3464 - DNA, 536 bp, Homo sapiens; identical to SEQ ID NO: 684

SEQ ID NO: 3465 - DNA, 525 bp, Homo sapiens
aagctcgggaattcgctcgagcttttcagaagtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtcgatgagagagcaaaaggcaatggctctagtcagccgggaactgcaaggcgaggtgtacagattattgatgatgaacctcaagcccagaccagtggtggagggtgctgttcttttggataactgttcacgcctaagaaattaaaagacagaacaaaactgtggatcattgccctcaacatgaagactgccatattccaagtcacattattttaccaatggaattatagaattaacagtattttaaattacgtttataacactgc

SEQ ID NO: 3466 - DNA, 462 bp, Homo sapiens
caagggcacgagcatcgggtagccatgcctttcttggacatccagaaaagttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcct

SEQ ID NO: 3467 - DNA, 402 bp, Homo sapiens
tacgtaagctcgggaattcggctcgagcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttc

SEQ ID NO: 3468 - DNA, 480 bp, Homo sapiens
taagctcgggattcggctcgagtctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagt

SEQ ID NO: 3469 - DNA, 322 bp, Homo sapiens
ccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaa

SEQ ID NO: 3470 - DNA, 520 bp, Homo sapiens
gctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggca

SEQ ID NO: 3471 - DNA, 336 bp, Homo sapiens
gcgaggtaagcggtggcgccttgggcggcgcacttgctgggtgacttggagggcatcggctagctgacattggtgatctgacggcagccaagcccagctcggatcaaggtcccttcatgcgcggtgtctctgcgcctgagtaacgacatggaactgaaagaccagagggacactaggaatcaaaacaaacatttctattctgcttagtttttctgttttgtaaatctttctttcttaccactttcagcccctgggattctagaactgtgaattgtgctctgttgtagggggcaggggaagctctcactctgttgccattaaatgtatgagactggg

SEQ ID NO: 3472 - DNA, 480 bp, Homo sapiens
ggttttgacagcgtggtgtccagtcctagccccctcagtgcttgctgttcacacttaagcaagtgaaggcctgaaggtgcccagctgtgccctcaggggaaacttaagtcacccgccctgtcagcacttggcccttgtcgggcagtgagagtggagctgcccccgcagcaccctcaggagccatgcagttcacagcagtagctggatctccctgaggacatttgtccttgcatatcttaatgatttgtccacagaaacaccgggttgtcttcctctgcccctctgccccgcagtgggggcactctctgtaactcagcatcacagtggggggcagctgggaggcctggttccaggtgaccttctccacctagatgttcaccccactcagttccagctttaccaacagggccccccgcagggacttggggtcgcagagtcccggcctgtctcagggccttgttcatggaagggagatgagtc

SEQ ID NO: 3473 - DNA, 493 bp, Homo sapiens
gaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccct

SEQ ID NO: 3474 - DNA, 609 bp, Homo sapiens
tcggctcgagtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaa

SEQ ID NO: 3475 - DNA, 521 bp, Homo sapiens
tccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacac

SEQ ID NO: 3476 - DNA, 588 bp, Homo sapiens; identical to SEQ ID NO: 703

SEQ ID NO: 3477 - DNA, 197 bp, Homo sapiens
cagccaaggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtga

SEQ ID NO: 3478 - DNA, 446 bp, Homo sapiens; identical to SEQ ID NO: 709

SEQ ID NO: 3479 - DNA, 311 bp, Homo sapiens; identical to SEQ ID NO: 710

SEQ ID NO: 3480 - DNA, 507 bp, Homo sapiens
atatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggct

SEQ ID NO: 3481 - DNA, 566 bp, Homo sapiens
tcatctgaacctctacctgctcctggactgttcgcagagtgtgtcggaaaagactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgca

SEQ ID NO: 3482 - DNA, 511 bp, Homo sapiens; identical to SEQ ID NO: 711

SEQ ID NO: 3483 - DNA, 526 bp, Homo sapiens
acaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcg

SEQ ID NO: 3484 - DNA, 557 bp, Homo sapiens
ggaaagaagtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagcctggttgtcttcttgcctgccctgtgtcgtaaatggggggtcccttactgcattatcaagggaaaggcaagactgggacgtctagt

SEQ ID NO: 3485 - DNA, 536 bp, Homo sapiens
tgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgag

SEQ ID NO: 3486 - DNA, 371 bp, Homo sapiens
taagctcggaattcgaattccactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctc

SEQ ID NO: 3487 - DNA, 613 bp, Homo sapiens
  misc_feature 535: n = A,T,C or G
tggtgccccctccacccatcattgacaagatcttcatggacacgcctgcccttctgacccctgcctgggaaacacgtgtgccacatgcgcactctcatatgccaccccatgtgcctttagtcccacggacccccagagcacccccaagcctgggcttgagctgcagaatgactccacctttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatnttgtgtattttcctggatttatagtatgtgacttttctgattaatatatttaatatattgaataaaaaatagacatgt

SEQ ID NO: 3488 - DNA, 170 bp, Homo sapiens
gccgcgggctctgcgtcaacactagtgccgtcagccgactgcgcgcctacctgctgccagcgcctacagctacaggaaatgctattgagtcggaggaagaccgcagcgccggcagagtggatagcccttccgtctgggggggcaccgggtgtttgatcccaagttccacc

SEQ ID NO: 3489 - DNA, 258 bp, Homo sapiens
attgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcataacaacaccgtgtactttgatgggaagtatgccagccccgacgtcttcaaatcc

SEQ ID NO: 3490 - DNA, 665 bp, Homo sapiens
gtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaatctacactcttatttg

SEQ ID NO: 3491 - DNA, 124 bp, Homo sapiens
  misc_feature 28, 47, 87, 90: n = A,T,C or G
gaattcttttgtgaaaggaacaaacttnattgttttaaaaaattganacaggcttccaaccttcagcagcccccacactgattaganagnagtcatcaatatagaggcaagactctcaccagca

SEQ ID NO: 3492 - DNA, 385 bp, Homo sapiens
tgcatggaggccggccgggtgaagtgtgagcattactggcctctggactcgcaggcctgcacccatgggcacctgcgggtaaccctggtaggtgaggaagtgatggagaactggacggtgcgggaactgctgctcctccaggtggaggagcagaagacactgtctgtgcgccaattccactaccaagcctggccggatcacggcgtaccctcctccccagacaccttgctggctttctggaggatgcttccgcagtggctggatcacaccatggagggaggcccacccattgtgcactgcattgctggcgtgggtcgcacaggatccctcattgccctggacgtcctgcttcggcagctgcagtacgagggtctccttgggccct

SEQ ID NO: 3493 - DNA, 565 bp, Homo sapiens; identical to SEQ ID NO: 725

SEQ ID NO: 3494 - DNA, 555 bp, Homo sapiens; identical to SEQ ID NO: 727

SEQ ID NO: 3495 - DNA, 577 bp, Homo sapiens
gtaagctcgggaattcggctcgaggcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtg

SEQ ID NO: 3496 - DNA, 616 bp, Homo sapiens
ctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgct

SEQ ID NO: 3497 - DNA, 510 bp, Homo sapiens
gtaagctcgggaattcggctcgaggcgccgacagaatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcc

SEQ ID NO: 3498 - DNA, 606 bp, Homo sapiens
ggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagatatgatgtggaagcacatgaacaaggacagggggacatccctacattttacacctatgaagaaggattatcccatctaacagc

SEQ ID NO: 3499 - DNA, 96 bp, Homo sapiens
gacgctgacctctgggggccacgctgagcacgaaggcaaaccctactgcaaccacccctgctacgcagccatgtttgggcctaaaggctttgggcg

SEQ ID NO: 3500 - DNA, 459 bp, Homo sapiens
aagctgtgtaatgaagaacaggaattgctgcgttttctatttgagaacaaattgaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttg

SEQ ID NO: 3501 - DNA, 360 bp, Homo sapiens
  misc_feature 360: n = A,T,C or G
gcatggccgtccgccagtgggtaatcgccctggccttggctgccctccttgttgtggacagggaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaactgan

SEQ ID NO: 3502 - DNA, 392 bp, Homo sapiens
  misc_feature 390: n = A,T,C or G
tcacacgctgggcttcacggctgccaggagcctctcccctccagaagacttgcctgctggggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcangg

SEQ ID NO: 3503 - DNA, 541 bp, Homo sapiens
tctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaagatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaa

SEQ ID NO: 3504 - DNA, 302 bp, Homo sapiens; identical to SEQ ID NO: 731

SEQ ID NO: 3505 - DNA, 297 bp, Homo sapiens
catcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccct

SEQ ID NO: 3506 - DNA, 534 bp, Homo sapiens
aagtcctctccctggaggcctatctccctcagaacggcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctct

SEQ ID NO: 3507 - DNA, 259 bp, Homo sapiens
ggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctc

SEQ ID NO: 3508 - DNA, 438 bp, Homo sapiens; identical to SEQ ID NO: 732

SEQ ID NO: 3509 - DNA, 500 bp, Homo sapiens; identical to SEQ ID NO: 735

SEQ ID NO: 3510 - DNA, 533 bp, Homo sapiens
accggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacagcccag

SEQ ID NO: 3511 - DNA, 358 bp, Homo sapiens
acagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacct

SEQ ID NO: 3512 - DNA, 373 bp, Homo sapiens
attcgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatc

SEQ ID NO: 3513 - DNA, 539 bp, Homo sapiens; identical to SEQ ID NO: 736

SEQ ID NO: 3514 - DNA, 573 bp, Homo sapiens
  misc_feature 441: n = A,T,C or G
tgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagnagcaacaacagcagaaaacctctgctctttctcctaatgccaaggaatttatttttcctaatatgcagggtcaaggtagtagtaccaatggaatgttcccaggtgacagcccccttaacctcagtcctctcc

SEQ ID NO: 3515 - DNA, 586 bp, Homo sapiens; identical to SEQ ID NO: 738

SEQ ID NO: 3516 - DNA, 580 bp, Homo sapiens
aagctcgggaattcggctcgagggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctgg

SEQ ID NO: 3517 - DNA, 541 bp, Homo sapiens
tggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttc

SEQ ID NO: 3518 - DNA, 542 bp, Homo sapiens
atatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatct

SEQ ID NO: 3519 - DNA, 633 bp, Homo sapiens
ttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaacttttgaagtgtgggaacgacctctctcaggcttagcctgggctgtagctatgataaaccggcaggagattggtggacctcgctcttataccatccagttgcttcctgggtaaaggagtggcctgtaatcctgcctgc

SEQ ID NO: 3520 - DNA, 519 bp, Homo sapiens
tcggctcgagcggctcgagccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccaggtgttgtcacaaattttgaaattttccgaatgagggagaaacaggtacctgtggatgtggtcg

SEQ ID NO: 3521 - DNA, 610 bp, Homo sapiens
caactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtcgtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgc

SEQ ID NO: 3522 - DNA, 506 bp, Homo sapiens
aagctcgggaattcggctcgaggcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtc

SEQ ID NO: 3523 - DNA, 646 bp, Homo sapiens
ttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggatcgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgt

SEQ ID NO: 3524 - DNA, 629 bp, Homo sapiens
taagctcgggattcggctcgagcggctcgagcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagt

SEQ ID NO: 3525 - DNA, 578 bp, Homo sapiens
ccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggct

SEQ ID NO: 3526 - DNA, 565 bp, Homo sapiens
gctgcgaggcgctgggcacagttgctgtcccctttgacgatgatgacaagattgttgggggctacacctgtgagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctg

SEQ ID NO: 3527 - DNA, 577 bp, Homo sapiens
gtaagctcgggaattcggctcgaggcgtcctcgtggaagtgacatcgtctttaaaccctgcgtggcaatccctgacgcaccgccgtgatgcccaggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactgg

SEQ ID NO: 3528 - DNA, 427 bp, Homo sapiens
attgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttcct

SEQ ID NO: 3529 - DNA, 382 bp, Homo sapiens
ggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtc

SEQ ID NO: 3530 - DNA, 299 bp, Homo sapiens
atggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaa

SEQ ID NO: 3531 - DNA, 404 bp, Homo sapiens
gggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaacct

SEQ ID NO: 3532 - DNA, 396 bp, Homo sapiens; identical to SEQ ID NO: 749

SEQ ID NO: 3533 - DNA, 505 bp, Homo sapiens
tgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaa

SEQ ID NO: 3534 - DNA, 314 bp, Homo sapiens; identical to SEQ ID NO: 750

SEQ ID NO: 3535 - DNA, 563 bp, Homo sapiens
accgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccc

SEQ ID NO: 3536 - DNA, 435 bp, Homo sapiens
ccagcggtgggcattgctgctggaatggcacgggccggcccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggat

SEQ ID NO: 3537 - DNA, 303 bp, Homo sapiens
  misc_feature 37: n = A,T,C or G
acgtttcctgtcactacacagagcacacctgggagangaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaatcacactggagagcgaccttataagtgt

SEQ ID NO: 3538 - DNA, 552 bp, Homo sapiens; identical to SEQ ID NO: 753

SEQ ID NO: 3539 - DNA, 377 bp, Homo sapiens
gaccccactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaac

SEQ ID NO: 3540 - DNA, 530 bp, Homo sapiens
gctcctcctcgcccgccgctaggtccatcccggcccagccaccatgtccatccacttcagctccccggtattcacctcgcgctcagccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagat

SEQ ID NO: 3541 - DNA, 521 bp, Homo sapiens
ccacaaaggttctgtggagatttgatgggaataaaccagataccttaggtctcaatactcggctctacaagtggataccccagaatgaccttctaggtcatccaaagaccagagcttttataactcatggtggagccaatggcatctacgaggcaatctaccatgggatccctatggtggggattccattgtttgctgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgata

SEQ ID NO: 3542 - DNA, 263 bp, Homo sapiens
gacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaagtcttaactttatacttagcaagttactccatcccaattt

SEQ ID NO: 3543 - DNA, 417 bp, Homo sapiens
cgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtt

SEQ ID NO: 3544 - DNA, 631 bp, Homo sapiens
aagctcgggaattcggctcgaggctggcagacctgtactccgtactccgtacttcgtagtcgcagcggcgcggtcttcggcagtttagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatgttcaagcagtctttgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcatggatgaggcctgcctgtgttaatacacctagtgaggagtggagctgaattgtgatgcaagccttggcaccttaattgagcaagtttgaaacctcgcttgttgcccttctggaaggagtca

SEQ ID NO: 3545 - DNA, 620 bp, Homo sapiens
cgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaa

SEQ ID NO: 3546 - DNA, 487 bp, Homo sapiens
aacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacct

SEQ ID NO: 3547 - DNA, 550 bp, Homo sapiens
gcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcaaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatc

SEQ ID NO: 3548 - DNA, 544 bp, Homo sapiens; identical to SEQ ID NO: 2693

SEQ ID NO: 3549 - DNA, 469 bp, Homo sapiens
aggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatacttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcct

SEQ ID NO: 3550 - DNA, 316 bp, Homo sapiens; identical to SEQ ID NO: 2636

SEQ ID NO: 3551 - DNA, 463 bp, Homo sapiens
tctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccc

SEQ ID NO: 3552 - DNA, 411 bp, Homo sapiens
gtaagctcgggaattcggctcgagcttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccag

SEQ ID NO: 3553 - DNA, 586 bp, Homo sapiens
gccctggtgctgacagccctgttggtggggctggggatgtcagtggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctattg

SEQ ID NO: 3554 - DNA, 519 bp, Homo sapiens
tcagacgtcgccttccacttcaatccgcggtttgacggctgggacaaggtggtcttcaacacgttgcagggcgggaagtggggcagcgaggagaggaagaggagcatgcccttagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatc

SEQ ID NO: 3555 - DNA, 585 bp, Homo sapiens
cgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgc

SEQ ID NO: 3556 - DNA, 594 bp, Homo sapiens
agctcggaattcggctcgagattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatattacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgc

SEQ ID NO: 3557 - DNA, 565 bp, Homo sapiens; identical to SEQ ID NO: 762

SEQ ID NO: 3558 - DNA, 530 bp, Homo sapiens; identical to SEQ ID NO: 765

SEQ ID NO: 3559 - DNA, 466 bp, Homo sapiens
  misc_feature 299, 413: n = A,T,C or G
ctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccagggngctgtaagtgccaacatgactgtgaagggccagagtgaagaccctggctccctcctttccttgttccggcggctgagtgaccagcggagtaaggagcgctccctactgcatggngacttccacgcgttctccgctgggcctggactcttctcctatatccgccactg

SEQ ID NO: 3560 - DNA, 250 bp, Homo sapiens
acagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggactcatctgatgatgtgagaagagttcagaggagggagaaaaatcgtatt

SEQ ID NO: 3561 - DNA, 485 bp, Homo sapiens
taaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaagg

SEQ ID NO: 3562 - DNA, 505 bp, Homo sapiens
attcgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctc

SEQ ID NO: 3563 - DNA, 499 bp, Homo sapiens
aagctcggaattcggctcgaggacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccg

SEQ ID NO: 3564 - DNA, 430 bp, Homo sapiens; identical to SEQ ID NO: 769

SEQ ID NO: 3565 - DNA, 478 bp, Homo sapiens
tcggctcgaggccctggggagggaggggagccccggagagcctgccggtgggagctggaagcaggctcccggctgagcgccccagcccgaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgtt

SEQ ID NO: 3566 - DNA, 465 bp, Homo sapiens
tgggcacaacagtttcagtgagtgccttttgagcacaccttttatttttattattagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtagggggggaagcttgaaggtgctcgcttcatttgccttgtttactcatcctgccctgtaatgtctgtaatcctgaagatggaataaattgtaacatttagtttctatc

SEQ ID NO: 3567 - DNA, 495 bp, Homo sapiens
acccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcgg

SEQ ID NO: 3568 - DNA, 427 bp, Homo sapiens
cttgttcctcaccaacctgccagaggagaccaacgagctcatgctgtccatgcttttcaatcagttccctggcttcaaggaggtccgtctggtacccgggcggcatgacatcgccttcgtggagttcgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggataacccccctgaaggtaagtccccccttgggggccttcttggagccgagtgtgattgagtggtcgccacacatcattggacccagagtctgtccccagacattgcacctggcgctgttaggccggaattaaagtggctttttg

SEQ ID NO: 3569 - DNA, 557 bp, Homo sapiens
ggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgc

SEQ ID NO: 3570 - DNA, 493 bp, Homo sapiens
gtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttgcactcaggtatccgtgcgggcactccatcacacgcagtatgagcgcttcatcccctcggcctacccctactacgccagcgccttctccatgatgctggggctcttcatcttcagcatcgtcttcttgcacatgaaggagaaggagaagtccgactgatgggctagagccctctccgcacagcgtggagacggggcagggaggggggtta

SEQ ID NO: 3571 - DNA, 409 bp, Homo sapiens
taagctcggaattcggctcgagcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgtaagttc

SEQ ID NO: 3572 - DNA, 293 bp, Homo sapiens
  misc_feature 98: n = A,T,C or G
ccgctgcgtgttttcctcttgatcgggaatcctgcttctccttgcctcgaaatggaccccaactgctcctgctcgcctgttggctcctgtgcctgtgncggctcctgcaaatgcaaagagtgcaaatgcacctcctgcaagaagagctgctgctcctgctgccctgtgggtgtgccaagtgtgcccagggctgcatctgcaaagggacgtcagacaagtgcagctgctgtgcctgatgccaggacagctgtgctctcagatgtaaatagagcaacctatataaacctggattt

SEQ ID NO: 3573 - DNA, 538 bp, Homo sapiens
ttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaaagctttgtatcatccagctctaatctatgataagtgtgtgga

SEQ ID NO: 3574 - DNA, 595 bp, Homo sapiens
gctcggaattcggctcgagcccaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagc

SEQ ID NO: 3575 - DNA, 204 bp, Homo sapiens
aagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggtaagtaaatgactaaatatatttcatt

SEQ ID NO: 3576 - DNA, 519 bp, Homo sapiens; identical to SEQ ID NO: 789

SEQ ID NO: 3577 - DNA, 534 bp, Homo sapiens
tggtacgcctgcaggtaccggtccggaattcccgggtcgacccacgcgtccggtgaaaaggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaa

SEQ ID NO: 3578 - DNA, 553 bp, Homo sapiens
tggtacgcctgcaggtaccggtccggaattcccgggtcgacccacgcgtccgaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctg

SEQ ID NO: 3579 - DNA, 582 bp, Homo sapiens
taccggtccggaattcccgggtcgacccacgcgtccgcccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagccctgccgaaacaggagcaaatggcgttttata

SEQ ID NO: 3580 - DNA, 653 bp, Homo sapiens
gaatttggccctcgaggccaagaattcggcacgaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctccccc

SEQ ID NO: 3581 - DNA, 120 bp, Homo sapiens; identical to SEQ ID NO: 324

SEQ ID NO: 3582 - DNA, 582 bp, Homo sapiens
tgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaag

SEQ ID NO: 3583 - DNA, 869 bp, Homo sapiens
  misc_feature 644: n = A,T,C or G
tgaactctgaactttttattggcctcctgctccccaaagggtaccctgcttctgctggcttaatgcctcagaactttggtgtcattggtctcagacaccactttgccatccactatccggcgggtggtggtcttttggatggtttgcatggagttgctgctgtccaaggcatcaccaagattaaagtcctcgccatcttccagcaggcggcggtaggtggcgatctcagcctccagcttgaccttgatgttcagcagggcctcatactcctgggcctggcgctgtccctctgcccgggtctgtgccagctctgactcaaggtgcagcaggatcccgttgagctgctccatctgtagggcgtaggggcctccacctccctcaggctgttctccaagctggccttcagatttctcatggagtccaggtcgatctccaaggactggactgtacgtctcagctctgtgagcgtcgtctcagcagctccaacctcagcagactgtgtggtgaccactgtggtgctctcctcaatctgctgagaccagtacttgtctagctcctctcggttcttccgagccagctcgtcataattgggcccggatgtctgccatgatcttggccgaggtctgagatttgggggcatctancctcaccgtcaaacccagaggtggcaatctgggcttgtagggcttttaattcctctttcgtggttcttcttcatgaagagaagctcctcttgaggagctcgattctctgtttccagctgagtcgtgtgaatatggtggtaaacatgacccgggggacccaagggatgtggttctccacaagatggggatgggcagtctcgtctcaatttgaattaaagtacatca

SEQ ID NO: 3584 - DNA, 436 bp, Homo sapiens
tggtacgcctgcaggtaccggtccggaattcccgggtcgacccacgcgtccggaaaaacatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccgaggtgggtgaattgcttgagctcagaagttcgggaccagcctgggcagcataatgagatacctgtctctatagaaaatacagaaattggccaggcatggtggcagccacctgtagtaccaggtactcgggtggctgaagcacgagaatcgcttgagcc

SEQ ID NO: 3585 - DNA, 385 bp, Homo sapiens
tggtacgcctgcaggtaccggtccggaattcccgggtcgacccacgcgtccgcccacgcgtccgggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatg

SEQ ID NO: 3586 - DNA, 578 bp, Homo sapiens; identical to SEQ ID NO: 794

SEQ ID NO: 3587 - DNA, 465 bp, Homo sapiens; identical to SEQ ID NO: 798

SEQ ID NO: 3588 - DNA, 567 bp, Homo sapiens; identical to SEQ ID NO: 800

SEQ ID NO: 3589 - DNA, 461 bp, Homo sapiens; identical to SEQ ID NO: 802

SEQ ID NO: 3590 - DNA, 352 bp, Homo sapiens
tggtacgcctgcaggtaccggtccggaattcccgggtcgacccacgcgtccgcatgtatccaaagctcactctgtagtatcacctggtagatgggttgacctgaaaggtccaaggtggcttcccttatgtgtctgccaccttacgggagatgggtgggaagctggctcatctggggctattaaccagaatactggcatttgtcctgtcctctggggtggatttgcccatcaaaacttgaagttctagcagggcagggtagatactcctactatagttccaactacctgggaggctgaggcaggaggatatctttagttcagcccgagcaagctagcaagaccccatctcttt

SEQ ID NO: 3591 - DNA, 290 bp, Homo sapiens; identical to SEQ ID NO: 2542

SEQ ID NO: 3592 - DNA, 363 bp, Homo sapiens
taccggtccggaattcccgggtcgacccacgcgtccgcagaggctcagccttcgggtgttcctggcaaaccctcacctccggaggccccacagctcagacctagtccttggttcacatggccccacttccatcctctttttcccttaagactgatttgtcctgggagatcactggatccctcattcaggtggagtgctgcaggacgacactttttccaggggtgacccaggcctgcagggtcccagtgtcacaggcaggccttgcccgagcctccacctgagcccctgctcctcttctcccacagggaggtggaggttacagtgaggtgagttcaggccactgcacttcagcctgggcaacag

SEQ ID NO: 3593 - DNA, 474 bp, Homo sapiens
ccaagaattcggcacgaggggccactgcctgaaagccgggccaaggccctcttccgtcagatggttgaggccatccgctactgccatggctgtggtgtggcccaccgggacctcaaatgtgagaacgccttgttgcagggcttcaacctgaagctgactgactttggctttgccaaggtgttgcccaagtcacaccgggagctgagccagaccttctgcggcagtacagcctatgctgcccccgaggtgctgcagggcattccccaagatgctgtggcagcagcagaagggggtgtccttccccactcatctgagcatctcggccgattgccaggacctgctcaagaggctcctggaacccgatatgatcctccggccttcaattgaagaagttagttggcatccatggctagcaagcacttgataaaagcaatggcaagtgctctccaataaagtagggggagaaagcaaacc

SEQ ID NO: 3594 - DNA, 663 bp, Homo sapiens
gaatttggccctcgaggccaagaattcggcacgaggcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacgga

SEQ ID NO: 3595 - DNA, 492 bp, Homo sapiens
cctttccaactttctgtttcagaggcagcagcagtgagctgcaattgcagccagccctttccccagccccactcccttctatgaactcctagccttcttcgcagacagcctagcatctggctaaagggcaccttgttagcaaacacaatttctatgaacggattacccatggactgaagctgttgttgccagcggctggaggaggggactccagacatgagtgttccatgagtgatgcagatgtggagtggaggtctcaggtgaggtgctgcagagccctgggtaacagaacgagtgagacagtaaggactaaactctagagatctttgcacaccttaactagcccgaggtccgtgtgacaagtccggtatgcactgcgggggaaatgcaccccaggcagaagccggcccttccaggcgtggcatcctggggcacctgccaggatgctcacagccctctcgtccacaaaccactgtcttcccttggcttctg

SEQ ID NO: 3596 - DNA, 210 bp, Homo sapiens
atttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgacaaaaaaaaaaatgaccctgtagacagcat

SEQ ID NO: 3597 - DNA, 424 bp, Homo sapiens
  misc_feature 347: n = A,T,C or G
taagctcggaattcggctcgaggcgaagccgggcccaattacggatccacggagttacaggcgccgacatgaagtcgcttctctggcgcccatctcccttcctggtctgagactagctctgggggaggcgggggcccccacactctgctcccgctccaccctgccctgcgctgctgctctgtgcctagctgtcaaaaccctggtgggggaggatgtggccaccctgagacccggaagacacggccgtctgcctgggtttgcggagagccgcttatgggtgtggtccgtccagacaccttgtttcaagggggatgggcgtgagcgggcaagcatagcatccccaccgntgagcaagaactttttcttgtttttaaaccatcacgtgctcatttcacattggaataaagtgagtttttgaaacctg

SEQ ID NO: 3598 - DNA, 616 bp, Homo sapiens
aagctcggaattcggctcgagggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaatgctttcagcaagga

SEQ ID NO: 3599 - DNA, 421 bp, Homo sapiens
tggtacgcctgcaggtaccggtccggaattcccgggtcgacccacgcgtccgcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttaactactttttataactaaatactctttaaatatttttatttcaatactgtggatggaaat

SEQ ID NO: 3600 - DNA, 445 bp, Homo sapiens
cggaattcccgggtcgacccacgcgtccggattttttagggccatactaaagggaatgagctgaaacagacctcctgatacctttgcttaattaaactagatgataattctcaggtactgataaacacctgttgttgttcactttgctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcaaaggcagcatccaagcccagagccagtgtcgactcttccgctggtgcctttcctctgaggggctatcaatgtgtagataaagccctgagtaggcaaaagcagtgacatccactgctatggtcttgat

SEQ ID NO: 3601 - DNA, 538 bp, Homo sapiens; identical to SEQ ID NO: 2735

SEQ ID NO: 3602 - DNA, 652 bp, Homo sapiens
cgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatg

SEQ ID NO: 3603 - DNA, 597 bp, Homo sapiens
tctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaact

SEQ ID NO: 3604 - DNA, 540 bp, Homo sapiens
ccaagaattcggcacgaggcgagactgcgtctcaaggaacaacggcaacaacaaaaaagaaatgggacagaaagttgtaaggccagatgtgggtgactcaccgactcgcagcgatgtcgaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtggga

SEQ ID NO: 3605 - DNA, 422 bp, Homo sapiens
tggtacgcctgcaggtaccggtccggaattcccgggtcgacccacgcgtccgatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaac

SEQ ID NO: 3606 - DNA, 438 bp, Homo sapiens
caggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacacgtggggagtggggtggggggagctatttccaaggcccctccctgtttcccca

SEQ ID NO: 3607 - DNA, 617 bp, Homo sapiens
aggatcagtccagagaagtaaaactcttttattttcaccgtccaaacatcagtcaatatactgggagagccagcggaaaccctcgccgtaaccttgcctcttgagcacactgcacatgaacacttccatggggcgagcattcagctccttcagggtcacattcccctttcctgtggtctgtccataaagcccaaatatctcacggagtttttcttcactgattgcatctgttctgtcaattttgttacccaagataaggattggcacattggatattgtttcatcagtcattaaagcattaagctcaactttggattccacgaggcgagaatgatctgcacagtccaccagaaagacaatcccattaattgctgggagataatttttccaaacgcgacgtgcttgctcgtgcccaccaagatcaaaagttgtaaaggtcattccagcaattgttagctcttctgatgtcggatgtagtgttggaacatgttggcccaatctgtcactttgagcaagtgaagaaaagtggttttgcctgcattatcccaacctcagaatacaagttttccagatttcttgtaaagtcccaggaactggagcaaactgccgaagccact

SEQ ID NO: 3608 - DNA, 500 bp, Homo sapiens
gaaaaccgaacatccactccagcaccctggagttctctccaaagcctggccagaggaatttgccttccttgtccttccggaaccagttgacatggaagatcttgggcagtttggctgctgggtgctgggccatgctaagccagtgggccaggtatttgccgaagttgtagccaaagaagggccgcatggcaaaggggtcatgcatgatgattttgcctttatgttctgcagccgctgtggcctctgatctcatggccgcccccacaaagactccatgttgccagctgagagcttcatagactagagggacaccagcaggtctacggcctccaaagataatgccttcaatgggaacaccttccggagactcccaggcagcatcaatgatggggcactggctggcaggggtgcagaacctcgagttggggtgggcacaaggttccccatcctctgagctccactccttattcttccaggacgtgatggtgacgcctgaagct

SEQ ID NO: 3609 - DNA, 503 bp, Homo sapiens
ccagggaaaagaacccccacccctcaacacagaattagccatgagaagaagcctgggcaacagcaactacaggccatgtttctcctccaaccgtgatgtaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaagagttccaagggaacacttgaaccatggacaagactctctcaagatggcaaatggctaattgaggttctgaagttcttcagtacattgct

SEQ ID NO: 3610 - DNA, 711 bp, Homo sapiens
  misc_feature 494: n = A,T,C or G
gtgtggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaagagtgccgaggattggttcttcagcaagacagaggaactgaaccgcgagtgggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcactgtcccagatccaggggctgattggcagcgttgaggagcagctggcccagcttcgcntgcgagatggagcagcagaaccaggaatacaaaatcctgctggatgtgaagacgcggctggagcaggagattgccacctaccgccgcctgctggaaggaagaggatgccacctgactcagtacaagaaagaaccgttgacacccgtaagtgcgtaccattgttgaagaagtcacagatgcaaggtcatctcctcccggaacaagtcaacagaacacc

SEQ ID NO: 3611 - DNA, 397 bp, Homo sapiens
tggtacgcctgcaggtaccggtccggaattcccgggtcgacccacgcgtccgggaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggct

SEQ ID NO: 3612 - DNA, 468 bp, Homo sapiens
  misc_feature 419: n = A,T,C or G
tctgccctataaagtccccttccccattcctcccaggtcccaggtgtggtggtataaggagagttggcccaatctgggagctgagggatctgagacatccatctactgcatcagtgcactcagaagtgaggattttggcacagttattcatgagacatcagcccatcatataaaacatgcctccagtttggttaaactaggaagcactatataatattttaaaatcagttacatgtcactgataaaagacttagtattaccatgatgttatttttcttgaggcaacatgatgaaacccattgtctacaaaaaatccaaaaattagccaggtgaggtgtgcacctgtagtcccatcttctcaggaggctgaggtgggaagactacttgagccaaggtggtggaggttggagtgagcccanattacaccacttgcactccagcctgggcaacagagtgaggccttgtctc

SEQ ID NO: 3613 - DNA, 409 bp, Homo sapiens
  misc_feature 322: n = A,T,C or G
tggtacgcctgcaggtaccggtccggaattcccgggtcgacccacgcgtccgctcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcangaggtggaggttgcggtgagccaagatcgtgccactgcactccagcctgggctacaagattgaaaagatcgaaactctgtctcaaac

SEQ ID NO: 3614 - DNA, 545 bp, Homo sapiens
aatttggccctcgaggccaagaattcggcacgagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaaggtgcggctgctccccgcatattcacgcgcacgcatgctccccacatatccacactcacgcatgcacgtggcacgctcgccagatttcccacacactcgccctcacctcaggagcctgctgcagtcctggtacaaggagggccttgctgcaccaacctcagcgcctggtgctc

SEQ ID NO: 3615 - DNA, 470 bp, Homo sapiens
gccctcgaggccaagaattcggcacgaggaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcg

SEQ ID NO: 3616 - DNA, 563 bp, Homo sapiens
  misc_feature 2, 529, 554: n = A,T,C or G
cnagtatcacaatgtttattgatagatacaagtatataaaatcagggcatgaacatgacttgataaattaagtagacttaatttcaatactataataggagggaccaattcaaattctcaccatttgtttcacacccacaaaaaccacttcaagggcattaacgatctctcaaaactgatcagttttgtgcaagtaaaccatgtttcttttaaaaagacttgtgcacttgcccaggctcaaggatattaaaatctagcacataaagcccattactagaggtagaaatacaggcaatatactattacggcaacaaccatcaattacagttaagaatttttctgtaacaaccaaatgggataatcaaatattgcaacaactcaagtattactgagcaaagtgcatttctacagtattcagtgttgctattcagttttctaacttaaaacagcctatgataactgggcagcaaagaaggtccttggcaatagactgcctctgcttgagaacttatggatggtaattattgcntgctgctaatatactatcctaaacnttaaaggta

SEQ ID NO: 3617 - DNA, 300 bp, Homo sapiens
cggattcccgggtcgacccacgcgtccggtgtggtctggctataaatttagactgttgcttgaaagaagcgaaaaacctccccttcatagacttccttcttcccatcccccctggcagccgctttgttcctctagccttgtaaaattttctctgtataaaacaggaacatcagccaaacatgtggacttccccactttccattcattagaagaatgcattatttcaaaatctcctgggagcatttaaatgcaaattttgtcaagaaagcaatttgagtcttagagaagctctctagccac

SEQ ID NO: 3618 - DNA, 701 bp, Homo sapiens
cagaaaaatcacattttattgatcacttttatttaaaattacaaaaatataaataaaaatagtgaaatataaatattcagtgtacaggagtggtcctcaccccacccagtgaggattggatgaactaggctaaaaggaagggataactggccaagaaagggacatctatgtgaaagtgaaactgagacagtgctggtcacaggtcatgctgcagaataatacattcccaggcactgtcacgtgggggacccaagaggccccaggagtgacctataacctctccagaaagaccactctgtgtggcatcacagtccacacagtttaaggaaatatttagacttaacaatcagacaccagctcttactcacacttacactcacagcccacacacaggtgtgcaaacatacacacacatatatatttcctgatacattcatggaatatcagagccctgccctgaagtcgttagtgtctctgctccccaaaccgctgctcccacattggctaagctccctcaagagacctcagctgttacacttcctaattgggaaattattcatttctcaaccatgggcctcacaaatgcccaccgtcgggggagctggctctcccttcacccatgcacaggagatgccctgcccttttaactcctgcaggctcagtccagaaaaaagcaagttgctggcagtaacatggtgagt

SEQ ID NO: 3619 - DNA, 667 bp, Homo sapiens
tttgactgtcgctagcatttttattgcatcatcaacaacaaacatgcagtttctttctctgatgtgcatggcactgtaaaatgggtgctacactctctcttgtggtacaaagtttataaatacagtatactgatacaaagttgaagccattaaaaagagcttaataacaactatgaggagataattaaatctggagtgttgatggaatctatgaagagatttagaaacaagacataaacactacggtaaaagttttacttgggaaggggccagaggggaactttttatgtgctactgaaagattttttaagttgctccagatttactttctttctgctattatctttaaatactgcaaagcattgtgagctgcatcactttgtgcattgccacaggagataccggagccatgacagactgtgatggggctggtggacagttcagcaagacattgatattgtccattggcgctcagttcatctatatccaaatatgttatattaaaaccttgttccttggcaatttcactaagcagctggatgtaatctgtatttggaatactaaggaggcttcttttcagtaaagtgatcttttcaccaggagaattcctcaaggaatgccaagtacatcctaaagaatgtcctactacatttgttaaagaaatgtg

SEQ ID NO: 3620 - DNA, 517 bp, Homo sapiens
tcaggccagggcgggatgacactgattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgact

SEQ ID NO: 3621 - DNA, 803 bp, Homo sapiens
tttgtggaatgtaaatcttttattaaaacagttgtctttccacagtagtaaagctttggcacatacagtataaaaaataatcacccaccataattataccaaattcctcttatcaactgcatactaagtgttttcaatacaattttttccgtataaaaatactgggaaaaattgataaataacaggtaagagaaagatatttctaggcaattactaggatcatttggaaaaagtgagtactgtggatatttaaaatatcacagtaacaagatcatgcttgttcctacagtattgcgggccagacacttaagtgaaagcagaagtgtttgggtgactttcctacttaaaattttggtcatatcatttcaaaacatttgcatcttggttggctgcatatgctttcctattgatcccaaaccaaatcttagaatcacttcatttaaaatactgagcggtattgaatacttcgaagcagaacaggcaatgtgcagccctcatttatgagaaaaccctcaggaaactcccagggtgatgcttggagaagctgtgagttgagctgaagctggagaacttcctccagagcaaagggcttaagaaagaaagaagaactctaagctgggtctgctaacatcactccagtttagatggatcttggcagagagacatgcttggtcctctggattggaaagatgatttactctcgggaatcttctctgtcagcctgtacatctaaaggcatgaagcactcaattgggcaattaaccattattgttggtcttctgtgggatctcttgggaatactg

SEQ ID NO: 3622 - DNA, 607 bp, Homo sapiens
cactatagggaatttggccctcgaggccaagaattcggaacgagggcgctgccggccccgagcgctcccgctaccacctgcagcagaacgtgcagttctccgaggacacagtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtg

SEQ ID NO: 3623 - DNA, 504 bp, Homo sapiens
tggtacgcctgcaggtaccggtccggaattcccgggtcgacccacgcgtccgcagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatact

SEQ ID NO: 3624 - DNA, 518 bp, Homo sapiens; identical to SEQ ID NO: 844

SEQ ID NO: 3625 - DNA, 517 bp, Homo sapiens; identical to SEQ ID NO: 845

SEQ ID NO: 3626 - DNA, 522 bp, Homo sapiens
tagtggatcccccgggctgcaggaattcggcacgagctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaagacagcgtcatgcagc

SEQ ID NO: 3627 - DNA, 648 bp, Homo sapiens
gacattgaccagaaaaagtgtttattcatcaagtctttaaagatacaaaaacacgtgtcttctgtggagctctgagaacaggactccagcaaagcacttttcagccttgtggtcttcaagcatttccaagatctttgctgcaaggagcattgtactcagcaattgcaaactcatccgtctcgtagtaatcatagactttcactatggctggtttcagatctcttactgggacatcttgcagaaccgtgaagaacaagctcagtgtctgatttgacaccttatcaaggtaaatcaagacatggttgctgctgacttctgtccggctcacatggttagatctttcaagcattttcactgttggcttcaggggaatgaagccagagaccatcttcacatcaacgatcgccatgttggaggcagagcggctccctgtgtaactgacacttagggagatttggaagctggtgtgggctttgggttcatcacagtttgaggcagagtctgcactcctaaagcaagggggaactcttcttttctgggagaatattgtatttcaaggatgtctgggaggtaggacacatccttctcgtgtcactttcatgcggtaatccccaaggcagctctgtcaatgagagcctgcggcagtaa

SEQ ID NO: 3628 - DNA, 826 bp, Homo sapiens
  misc_feature 26, 27: n = A,T,C or G
tttatgtacagatggcacatggtcannttttatttgtaaatatagtactccaactcaagtttacaagttacacctttgccacagccttggtaaatcttgaactagtgcagaattcagctgtggtagagtgctgatcttagcatgcttcgatgtggcatacttgttcttgacagtcatgtgctttgtaagtccttgatttaccatgactacattcttagccaggtgctgcataactggaagaagagattcttcagtatatgacaggtaatgttgtagagttggtgtccattcaccattatccagaattttcagtgctaagcaaaaagctcctgctgcaatttgagaaggaggaaagtgcaccatgtcatagtccaacatagttagttccatcaggtatttgggctaaagtatgttgctcgacatcaacctctccaatcttagatgctctccgaagaagtggcaaaggtagaggccgacccagaccaaagtttaaagctcttagaatcttcatttccatctgtcggaattggtgcttagtataaagtgttgtcagtcacaaaagcaaagtcaccaattttctggaggggacatttcttcatatttgcttgcaataaacatggcagtgacaccaaccagctgcagcatcttcttgggcacacaattaatctgcatgaaacgatcaataatggagacagtcatgtacaaggtctcctgcaaaaacccgaatttcatttgaacctgaactagccgtccattaggaaggcctcaagtttcccgtgattcccgatccataggtaattgggctgacagctggccctactcaagt

SEQ ID NO: 3629 - DNA, 500 bp, Homo sapiens
tggtacgcctgcaggtaccggtccggaattcccgggtcgacccacgcgtccggtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatct

SEQ ID NO: 3630 - DNA, 419 bp, Homo sapiens
tggtacgcctgcaggtaccggtccggaattcccgggtcgacccacgcgtccggtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttct

SEQ ID NO: 3631 - DNA, 535 bp, Homo sapiens; identical to SEQ ID NO: 860

SEQ ID NO: 3632 - DNA, 609 bp, Homo sapiens
aatttggccctcgaggccaagaattcggcacgaggggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacac

SEQ ID NO: 3633 - DNA, 400 bp, Homo sapiens
tggtacgcctgcaggtaccggtccggaattcccgggtcgacccacgcgtccgaaaatgtgcaattttcatacagcatcccagtgttgatcatggaggttaatgattctttattgttagggacctatcttgtaattccagagttatttatgttttctacagttgaagaggaaaaataccgcttcttattgcctccttttcaggatttcttctggcttcttgagtagctggagtatttttgagagactcctacaggccctgcggggtggcacatgcctgtaatcctagctacttaggaggctgaggtgggagaattgcttaaacccgggaggcagaggttgcagtgagccgagatcgcatcactgcactccagcctgggcgacagagcaagactctgtctcg

SEQ ID NO: 3634 - DNA, 330 bp, Homo sapiens
gaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaaaggtttgaccaaagttgccatctcattaacaaattatgacctgtttctcttgccgttgtcactggatagtgtctttttttttctccctgagacggggtcttgctttgttgcccagaggtggagtgcagtggtgcgatcttggttcactgcaccctctgcct

SEQ ID NO: 3635 - DNA, 493 bp, Homo sapiens; identical to SEQ ID NO: 863

SEQ ID NO: 3636 - DNA, 449 bp, Homo sapiens
tggtacgcctgcaggtaccggtccggaattcccgggtcgacccacgcgtccggggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaa

SEQ ID NO: 3637 - DNA, 650 bp, Homo sapiens
  misc_feature 206, 207, 294, 376: n = A,T,C or G
gaatattcacatctgtttaatgtgcataaagccaaggaaaggacagttccgaattcaatagaaatattctgtacaattcatatggtggggttgagggggagggggacaaggctgtagaacccacacccgaacatgtacaaaaataacttatacagcaacccccacctgcaaggatgatgcagctctgcccagccaccggggctggnnggcacactgcagacatggcaccgcgggagccaaccagtatgggccccagatgcaggtgggagtgaggagggcaccagtccggagggnagggcagctattaggaggccttgagacggttgctggccgagcgtgactcagcagcttgtccaccatagtgcgggcgtaggangccggctggccagctccttgcagcagccgtactcctccaggagactcaggcggtatgtgcggaagtcccgcttctcgtcgatgtaggtcaccgctgccatcagtgggcacaagatgagcttggtgttgtcctggaaaaagttgatctgcacgcttccgtttgctgaggtgcagaataaggcgcctcgggttgcgaaacaggtccgtaagtagggcagccgggcgagctcatcaccctcgcgccgcgtaatgtttggcaccttcttaagcaagtg

SEQ ID NO: 3638 - DNA, 562 bp, Homo sapiens; identical to SEQ ID NO: 868

SEQ ID NO: 3639 - DNA, 671 bp, Homo sapiens; identical to SEQ ID NO: 869

SEQ ID NO: 3640 - DNA, 74 bp, Homo sapiens
tgtaaagtgccttacagggtaactgtgctgaatgctttacatgaggaaatgatccccaagtggtgaatgacacg

SEQ ID NO: 3641 - DNA, 509 bp, Homo sapiens
aaaagacagccaaaaaaggtcgcgcaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcacc

SEQ ID NO: 3642 - DNA, 624 bp, Homo sapiens
taaatcttgacttgaacgaccaagtggactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaa

SEQ ID NO: 3643 - DNA, 563 bp, Homo sapiens; identical to SEQ ID NO: 871

SEQ ID NO: 3644 - DNA, 586 bp, Homo sapiens; identical to SEQ ID NO: 873

SEQ ID NO: 3645 - DNA, 555 bp, Homo sapiens
tggtacgcctgcaggtaccggtccggaattcccgggtcgacccacgcgtccgggaagttagtaggactcacttctctgattaataagcaattgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactca

SEQ ID NO: 3646 - DNA, 520 bp, Homo sapiens
tggtacgcctgcaggtaccggtccggaattcccgggtcgacccacgcgtccggaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccag

SEQ ID NO: 3647 - DNA, 418 bp, Homo sapiens
tgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 3648 - DNA, 560 bp, Homo sapiens
tctgcaggtatgaccccgaaggggacaatacatgggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttac

SEQ ID NO: 3649 - DNA, 520 bp, Homo sapiens
aatttggccctcgaggccaagaattcggcacgagggcataagcagcagtgcatgaaggagctgcgggcgtgccatcagtctgaagcctataagatgtgcacggagaacatccacgataagatgatcaagatagaagactcgagctctgggctcatgaacactctcctgaatggacacacgggtggggactgcgatggcttctccaccttcgatgttcccatcttcactgaagagtggttggaccaagacaaagcgcgtgatgcggagcttccgcgcttgcggaagatgaatgtggccttcgaggatcacaccgcggtactgcagaagcacacgcagagcatgagcatcgcgcgcgagcgtctggagcaagagctggcgctggaggagcggaggacgctggcgctgcagcagcagctgcaggccgtgcgccaggcgctcaccgccagcttcgcctcactgccagtgccgggcacgggcgaaacgcccacgctgggcactctggacttctacatggcccggc

SEQ ID NO: 3650 - DNA, 473 bp, Homo sapiens
cagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacac

SEQ ID NO: 3651 - DNA, 504 bp, Homo sapiens
tggtacgcctgcaggtaccggtccggaattcccgggtcgacccacgcgtccgaccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgcccc

SEQ ID NO: 3652 - DNA, 419 bp, Homo sapiens
gaatttaactactgagtaggtgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttacatttgaaggattgctaaattgtcacagtagtaggaagtatatggaaacc

SEQ ID NO: 3653 - DNA, 552 bp, Homo sapiens
  misc_feature 426: n = A,T,C or G
ccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcagaggaggaggatcggcggactgtggggaggagaccccacgccaccctttctggtcatctcccctcccgccccgcccctgcgcacactccctcgcgggcagctactttcggaccaggaaagtaagagcggccctgggtgacagcgccgcggggccagtcccggggttagccgcgcgtctgctcgcttctggtccgtcgcgctcccagccagggcacagcgganccgaggatggcttcgaccacaacctgcaccaggttcacggacgagtatcagcttttcgaggagcttggaaagggggcattctcagtggtgagaagatgtatgaaaattcctactggacaagaatat

SEQ ID NO: 3654 - DNA, 527 bp, Homo sapiens
ctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatca

SEQ ID NO: 3655 - DNA, 445 bp, Homo sapiens
tgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgat

SEQ ID NO: 3656 - DNA, 463 bp, Homo sapiens
taatgtggtataaattcattgttaatgagaacaataatgttactctgctggaggacagagtcctgaaggctgagtatggcgccatcctgtcactatgtgagttttctcttgatgatagtgagctctttctgaagttcactgaacttagggcgattttcaggtttataatcccaacacttcatcatgattttggaaatatcctctggacagtgctggggagctgacatccggtatcctctttctacttgctctcttgcttgctgatttgtcattccagggtacggacaaacccctaagctgaaggtctcccagagaaggatgccaaagctccacacgtcactctctgaactgtatctcccataattaagagcttccggtgctgtccatttaatgggaatctcgcttaagccagaagatgaatacactccaccatccccctgacgagacattcccaagtcacctg

SEQ ID NO: 3657 - DNA, 581 bp, Homo sapiens
aattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgcttg

SEQ ID NO: 3658 - DNA, 625 bp, Homo sapiens
tgtttttagatatttttcctataggtttctgctgtggagccgtactcactgcagaccctgaaggaggaggagcacctgctttctgccactcagtgcgctcagctgccattcttctcacatatgcatcatccacacacatcaagatattttccggctttatgtcagtatgaatgatcttgcacttactgtgtaagtaatctaacccttgaaggacctgtcgaatgatactcttcacacaacgtactgggaggccttgatagttggatttgatgatccacttgaggagatggtggccaagtacttcgaagaccatgcagacatgtatcccattcatgcctgaaatcttgaagtcgtcaatgagctggaccaccatgtctttgtttgggtcactgggatcactttctcgaacacatttgagcaattttatttcatccaaggctgtctccgtataatgctgggcactttttacaactttcattgcaacaaatcttttcccctgcatatccccgcacagccagacagtagagaagtgcccccatccaagcttttcaataacatgataccgggccatgaagagggtctccattttcaccggatgatatcccactttgcagtaagtcgcagg

SEQ ID NO: 3659 - DNA, 531 bp, Homo sapiens
gctgctgctggatactcgtgttttcggggatcgaggatactcaccagaaaccgaaaatgccgaaaccaatcaatgtccgagttaccaccatggatgcagagctggagtttgcaatccagccaaatacaactggatatctgctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgacgagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatgg

SEQ ID NO: 3660 - DNA, 721 bp, Homo sapiens
cactgttataataactttaatttatcttgcattttacagaagtctatgaacgattttaaaaaagcacctccttaccccatatcacgtttctctgacaggtgttaaagtaggcaatgagtatgtcaacagcttgagcatcagcgtcttgcaaggacttcagaccaaccactcgccaaaaatcttggcagcttttttatcttgtttttaatacaacggtatatccactctgatggcaaacctgtccagccacatctccacaacaagctttgcaaaatcagtgattagcaaattagttagctttggcacggagctgtgctcgcttgcccgtgacagcctggaagccggttttgatactggcaacagaacatctagaatgacaagtttcgcactgtaggaaatagagtcgtgtgtccttctgcaggattgtgtccggtgatcggcatgtgtgacaagtgacatattccttgatatatcttctcaagacattttctatctgttcctgttggaatcttcctttgattacaagttgggtattaccatctatagaaccacttgtacccaattcagccaaccaaaatgccaggagatgtttgggctgacgatgtaatagtttacagatatctgtaaagttgaccaagaagttttctgggtcctactcggacgactgtggagggttccggcaaatttccttttcccccgaagcctatccgggatctttccc

SEQ ID NO: 3661 - DNA, 595 bp, Homo sapiens
taccggtccggaattcccgggtcgacccacgcgtccgggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattattgtagacatgataaaagaaacatttgtatgttctt

SEQ ID NO: 3662 - DNA, 529 bp, Homo sapiens
tggtacgcctgcaggtaccggtccggaattcccgggtcgacccacgcgtccgaaagagcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcactgccttcaggtggtgctgccccagaaacttaaaatttagtcgaggcagtttcaattgttactgtggaccgaattaggatcacaataaacgataatgcaggtt

SEQ ID NO: 3663 - DNA, 325 bp, Homo sapiens
ccgggtcgacccacgcgtccgaaatttattagtgaaaggaaagacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttggggctcatgcctgtaatcccagcactttgggaggctgaggcgggtggatcactaggtca

SEQ ID NO: 3664 - DNA, 181 bp, Homo sapiens
tgcaggaggtgctgtgggttggagccgtgggctgtggagggtttgtgtatgatgagaagccctgtacagtcttctcaagaaataccctgagccagtctctgagacgcttcggtaaaaaatgtccctggatggaatcaagattttaaattcaaataaagcctaatatcatgttgtgtccaca

SEQ ID NO: 3665 - DNA, 425 bp, Homo sapiens
  misc_feature 32, 372, 392, 399, 420: n = A,T,C or G
cgctccaatgtccagcccacagctgcccctgnccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccgggagaaggatctacttgattctagagtatgccccccgcgggagctcttacaaggagctgcncaaaagcctgcacaatttgncgagcancgaacagccacggtcccgggnggatc

SEQ ID NO: 3666 - DNA, 543 bp, Homo sapiens; identical to SEQ ID NO: 895

SEQ ID NO: 3667 - DNA, 263 bp, Homo sapiens
gtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagaggtcactattccaatt

SEQ ID NO: 3668 - DNA, 475 bp, Homo sapiens
tggtacgcctgcaggtaccggtccggaattcccgggtcgacccacgcgtccgctcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagt

SEQ ID NO: 3669 - DNA, 505 bp, Homo sapiens
taccggtccggaattcccgggtcgacccacgcgtccggctgagtcacccaagaaaggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatac

SEQ ID NO: 3670 - DNA, 526 bp, Homo sapiens
tataggaatttggccctcgaggccaagaattcggcacgaggtgcaatgcattctgttgaggggctacatgaaaggttgtttcttgaacaggatgagtttcaacagtgacctgtgtatgagcttcagtgcctgaccaaccaagaggagcaggaaattgctgacgcacctggggactgtgtgtctcgcagtccatggcctgcacggcagctgtgaagtgcccaccactgtgccgatgctggtgcgtcggatccgaccgggctctcccactgttgcttgtccccgatgagccacctgagcttgaccatgtactggaggtggtgcccgaacactgagactgctccatggcggggcttgtagatacactattacttgtatttgtaccttcatcagctgttttcttgaagaaactgtgctgcagagcataataaggttgaattcgagttttggggtcataatcaagcatccttaaaatgaggtctttgaacttcaagtagtcagcgaccgtatgacctgactccccagcacg

SEQ ID NO: 3671 - DNA, 563 bp, Homo sapiens
aaggtgaaggacgaaccacagagaagatccgcgaggttgtctgctaaacctgctcctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagt

SEQ ID NO: 3672 - DNA, 580 bp, Homo sapiens
gaatttggccctcgaggccaagaattcggcacgaggggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagag

SEQ ID NO: 3673 - DNA, 518 bp, Homo sapiens
aagaatatccgctaaggatgccttagcccacccctacctagatgaagggcgactacgatatcacacatgtatgtgtaaatgttgcttttccacctccactggaagagtttataccagtgactttgagcctgtcaccaatcccaaatttgatgacactttcgagaagaacctcagttctgtccgacaggttaaagaaattattcatcagttcattttggaacagcagaaaggaaacagagtgcctctctgcatcaaccctcagtctgctgcttttaagagctttattagttccactgttgctcagccatctgagatgcccccatctcctctggtgtgggagtgatggtggaagataatgtactactgaagatgtaatgtagctttccactggagtctgggatttgcaattctggaggttaatcatgcttgtactgtaattttactaatgaagttttaaattaacaaccactacttgtatgatatgaataatatttagaaatgttactagacttttaatc

SEQ ID NO: 3674 - DNA, 701 bp, Homo sapiens; identical to SEQ ID NO: 899

SEQ ID NO: 3675 - DNA, 494 bp, Homo sapiens
tggtacgcctgcaggtaccggtccggaattcccgggtcgacccacgcgtccgctgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactg

SEQ ID NO: 3676 - DNA, 289 bp, Homo sapiens
gggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaagaagtct

SEQ ID NO: 3677 - DNA, 617 bp, Homo sapiens; identical to SEQ ID NO: 902

SEQ ID NO: 3678 - DNA, 303 bp, Homo sapiens
taagctcggaattcggctcgagctgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatact

SEQ ID NO: 3679 - DNA, 626 bp, Homo sapiens
agactgcttcatcttttatcccagaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttg

SEQ ID NO: 3680 - DNA, 484 bp, Homo sapiens
tggtacgcctgcaggtaccggtccggaattcccgggtcgacccacgcgtccgagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcag

SEQ ID NO: 3681 - DNA, 433 bp, Homo sapiens
taccggtccggaattcccgggtcgacccacgcgtccgaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatg

SEQ ID NO: 3682 - DNA, 277 bp, Homo sapiens
gacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccct

SEQ ID NO: 3683 - DNA, 534 bp, Homo sapiens
ggttagcatccagcgacagatcaaccatccctttgtacacagcttgggggacagctggcagggaaaacggcaccttttcattatgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgagatacagaaattagctggtcatgagggcacacactgtggtcccagctactcgggaggctgagggggaagaattgcttggacccgggagatggaggttgcagtgagtggggatcgtgccactgcatccagcctgagcaacagagtgagatcttgtctcaggaaaaaaataaatttaattgctgtggatactgtaaagggtgtttatcgtaacagttcataatattctatttaagaatgcgtgggagaaattttctctggacccagttatgcttttcctg

SEQ ID NO: 3684 - DNA, 551 bp, Homo sapiens
ggccctcgaggccaagaattcggcacgagaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctg

SEQ ID NO: 3685 - DNA, 521 bp, Homo sapiens
cgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatg

SEQ ID NO: 3686 - DNA, 457 bp, Homo sapiens; identical to SEQ ID NO: 334

SEQ ID NO: 3687 - DNA, 459 bp, Homo sapiens
taccggtccggaattcccgggtcgacccacgcgtccgccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcat

SEQ ID NO: 3688 - DNA, 502 bp, Homo sapiens
  misc_feature 383: n = A,T,C or G
tggtacgcctgcaggtaccggtccggaattcccgggtcgacccacgcgtccggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctgnggcaagacagtgattgaatacaaaaccaccaagacctcccgcctgcccatcatcgatgtggcccccttggacgttggtgccccagaccaggaattcggcttcgacgttggccctgtctg

SEQ ID NO: 3689 - DNA, 557 bp, Homo sapiens
acgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagacatcctgtggctggactac

SEQ ID NO: 3690 - DNA, 590 bp, Homo sapiens
gaatttggccctcgaggccaagaattcggcacgaggcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgct

SEQ ID NO: 3691 - DNA, 463 bp, Homo sapiens
gggaatttggccctcgaggccaagaattcggcacgaggctgacggcagcttccccgccggcttcgtcttgcagctcttctcccacacccagctcaggggcccagacagcaaggactcacccaaagacagggaagtggcagaaggaggccttccccgggcggagagcccctctccagggagccctcatttcaagtcctggggtaccctgtgcgcaaactccatctatctggagtggtatataggctggaggcagtaaatctttaaaaaccaggggcccccgtggcggttctttgcggagcagaggctctggacctgtggtttcagacgatctcacgaacccaaagcttggacagatttctcagaaacctgtgaggcttcgaccaaaatgtctctactttctgtgttgttatgtacgtattgaagttctctgaagactttatttaaataaagatcctgccacttt

SEQ ID NO: 3692 - DNA, 624 bp, Homo sapiens
tcggcacgaggcaatcatgcacttaactaccaaaaagagtaaactcctctcagagacttcttaatacagttcagtgcaaataaaatacatttgctgtttgatgtagcatgagaaatcccaagtccttctgttcctttactgaaaagtagctgtttgtaagtaagatctgcatcataaaaactttctaaatccctaagtaagagatatcaagtgcccagcagtttcctaaatgtcagtacacataggtagccagtcaccctcaaaaagtccagcagttttatcaggaaggaatctaaagatatctatcttccaagctggctctgggtctctcagctttttcaaactaaatgtgtggtcgtgggattgcttgctttcgcaggttctaaacgctgtttccctggtctgtttttcagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgc

SEQ ID NO: 3693 - DNA, 576 bp, Homo sapiens
tgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgc

SEQ ID NO: 3694 - DNA, 589 bp, Homo sapiens; identical to SEQ ID NO: 2942

SEQ ID NO: 3695 - DNA, 568 bp, Homo sapiens
ataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtg

SEQ ID NO: 3696 - DNA, 542 bp, Homo sapiens
tggtacgcctgcaggtaccggtccggaattcccgggtcgacccacgcgtccgcccacgcgtccgtgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagc

SEQ ID NO: 3697 - DNA, 536 bp, Homo sapiens
gtatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattact

SEQ ID NO: 3698 - DNA, 522 bp, Homo sapiens; identical to SEQ ID NO: 2866

SEQ ID NO: 3699 - DNA, 634 bp, Homo sapiens
tggtacgcctgcaggtaccggtccggaattcccgggtcgacccacgcgtccgggctggtctcagactccttgccttaagcagtcctcccacctcagcctcctaaagtgctgggattacaagcgtgaagcattacatccaagtgaaacttcttgagatggttacataatgtctaaatctgctggtgtagaagttaataaagtgtagaactgaataactattaaatattagatcaagtttctcatgtttatcttaacgtataacgatttatcttaaagcactgattttcacaaaataacatcagtgtgaaattggaaaagaagccaaatattttatttcatgtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcacgcctataatcccagcaccttggaaggccaatgagagtggatcagttgaggccaggagtttgagaccagcctggccaacatggtgaaatgccgtctctact

SEQ ID NO: 3700 - DNA, 559 bp, Homo sapiens
tggtacgcctgcaggtaccggtccggaattcccgggtcgacccacgcgtccgcgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatag

SEQ ID NO: 3701 - DNA, 544 bp, Homo sapiens
cttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgag

SEQ ID NO: 3702 - DNA, 630 bp, Homo sapiens
gaatttggccctcgaggccaagaattcggcacgaggaaagaatgcagcaaaaagtaatgttacagtgttatgctttcagagccttgagatttctcttcagtatggaaagaaacagaccactcttttaaagacttttccccacagacttgtttgagatcttcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttgggaaggataagaaagatcgagacagcagcgtaaggaatattgtttctgaattaacaataattaaagagcagctttatcatcccaacattgtacgttattacaaaacatttctggaaaatgataggttgtacatagttatggagctgatagaaggagccccgcttggagagcatttcagttctttgaaggaaaaacatcacc

SEQ ID NO: 3703 - DNA, 789 bp, Homo sapiens
gatactggaaaagattggggaaggcacctacggaactgtgttcaaggccaaaaaccgggagactcatgagatcgtggctctgaaacgggtgaggctggatgacgatgatgagggtgtgccgagttccgccctccggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgctcaccggatgtcctctttgggggcaagctgtactccacgtccatcgacatgtggtcagccggctgcatctttgcagagctggcccatgctgggcggcctcctttttccggcaatgatgtcgatgaccagttgaagaggatctttcgactgcttgtgacgccaccgaagaagcagtggcctctattgacaagctgccagactataagcccaaccggtgtacccggccacaacatcctggtgaagttgtgcccaaatccatgcacaaggagggattctgctgcaaacttctgaatgtaaccc

SEQ ID NO: 3704 - DNA, 576 bp, Homo sapiens
tggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaa

SEQ ID NO: 3705 - DNA, 472 bp, Homo sapiens; identical to SEQ ID NO: 2515

SEQ ID NO: 3706 - DNA, 213 bp, Homo sapiens
  misc_feature 84: n = A,T,C or G
tgcagaaatggggagcacttgaggacacaggtgggtggaggccctttgtgcgtggctggtcgtattcgggcagccctccgtcgntttttataaaactttgtgtgagaagaatatattgataatgtcagtgaaacaagcagacattgaaatggaggcacagattactccacaaggagttcttctgtatattttttctagatgcaaatacctttt

SEQ ID NO: 3707 - DNA, 366 bp, Homo sapiens
taccggtccggaattcccgggtcgacccacgcgtccggttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttctttt

SEQ ID NO: 3708 - DNA, 353 bp, Homo sapiens
cgaattcggctcgagcggctcgagcggctcgaggcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagt

SEQ ID NO: 3709 - DNA, 247 bp, Homo sapiens
tggatcccccgggctgcaggaattcggcacgagatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccatt

SEQ ID NO: 3710 - DNA, 593 bp, Homo sapiens
catacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtc

SEQ ID NO: 3711 - DNA, 628 bp, Homo sapiens
atagggaatttggccctcgaggccaagaattcggcacgaggacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccaacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagc

SEQ ID NO: 3712 - DNA, 557 bp, Homo sapiens
cggcacgagtattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggagggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcaattttctgaagtctgaattcaattacaatttttttttaccaatttaatctcaaatgttgtttaactgctttaaattcatatacgtagagtattataaactgcagagatgaaaaatgtgttttcacgggatttatattgtgaactaaactaagcctacttttt

SEQ ID NO: 3713 - DNA, 537 bp, Homo sapiens
tcttcaaacaccttctttcaattcatcctgagtgactttgtaagggagatttttagccaaaagtgttctcgcatctcgctctttcttactgtcttttccttttggtttctctagtttaatttcattgccaaagactttcaaaccagtgagttccaacgctttctccaggtcttcagcagggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgt

SEQ ID NO: 3714 - DNA, 237 bp, Homo sapiens
tagtggatcccccgggctgcaggaattcggcacgaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccatt

SEQ ID NO: 3715 - DNA, 502 bp, Homo sapiens
tggtacgcctgcaggtaccggtccggaattcccgggtcgacccacgcgtccgtggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcacccttcatacttcatg

SEQ ID NO: 3716 - DNA, 533 bp, Homo sapiens
tggtacgcctgcaggtaccggtccggaattcccgggtcgacccacgcgtccgctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgtta

SEQ ID NO: 3717 - DNA, 519 bp, Homo sapiens
tggtacgcctgcaggtaccggtccggaattcccgggtcgacccacgcgtccggtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacagctttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaacttt

SEQ ID NO: 3718 - DNA, 406 bp, Homo sapiens; identical to SEQ ID NO: 2719

SEQ ID NO: 3719 - DNA, 671 bp, Homo sapiens
  misc_feature 120: n = A,T,C or G
ttttctgaatcaaagatttttattgattctcctgccaaacacaactgatttccatctacaattactttttaaggtaagaaacagtaagtcaactgaacaaagagctgggctttgggcctnggaacgtgattacacaccgactgagaaatgcaggacctcagggtggggtctagtcaggctggccgcagcagggcacgaacctgcctcagtgggccttctccaagaacgctctgcagcacctgacacactgctggtacaccgtctcaaagtcagagtcattcccataatagggatcttcaataataagttgtttttgtggatcatagctcccaagtagttcaattttagctttgcaggttttaacttgattactttttctattcaaatctctcagattgctttcatccatacatagtatataatcaaatgtggcaaaatcttctttggtaatctgccgggcaacgtggctcatgggaatgccgtgcctcttcatgcagctctgccctcggtagtcaggggggttcctatctcatacccggaagttgccgcgctgtctaccctccaattctctgagatgttttgatcggttacaagtttcctgaaaactgcttctgcaatgggtgatcgacaatgttacccagacacccaaacagcacggacttggtagcctg

SEQ ID NO: 3720 - DNA, 103 bp, Homo sapiens
actccagctgaggactggtggggactgtgtgtgctgctctacaagatgctggttggcgagtccccattcccaggggatgatgaggaggaggtcttccacagca

SEQ ID NO: 3721 - DNA, 468 bp, Homo sapiens
  misc_feature 48: n = A,T,C or G
taccggtccggaattcccgggtcgacccacgcgtccgggcactgtggngaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatagctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtg

SEQ ID NO: 3722 - DNA, 51 bp, Homo sapiens
tggtacgcctgcaggtaccggtccggaattcccgggtcgacccacgcgtcc

SEQ ID NO: 3723 - DNA, 413 bp, Homo sapiens
ctggtacgcctgcaggtaccggtccggaattcccgggtcgacccacgcgtccgggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctc

SEQ ID NO: 3724 - DNA, 227 bp, Homo sapiens
tcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaag

SEQ ID NO: 3725 - DNA, 466 bp, Homo sapiens
  misc_feature 4, 75, 79, 450: n = A,T,C or G
aganaaacgcagtaccatggtcggaacgccatactggatggcaccagagttggttacacggaaagcttatggccntaangtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaaagaagcaaatgaagagtaaccgttaacatcactgctgtggcctcatactcttttttccattttctacaagaagccttttagtatatganaattattactcttttg

SEQ ID NO: 3726 - DNA, 463 bp, Homo sapiens
tggccctcgaggccaagaattcggcacgaggatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtaggtaggtaacctcggtccagtatttggccatttgaattctgccagctagagttggtcagatcggttgtttatctaaaaatgatttctagagaatttctgttaaattggccttaactagcaaattgggtttcataaatgccatatatgcctaaagctggcatttcgtttatttcaacctttagatggcaaatgtctaaagtatatttgtgagtacaaa

SEQ ID NO: 3727 - DNA, 465 bp, Homo sapiens; identical to SEQ ID NO: 946

SEQ ID NO: 3728 - DNA, 438 bp, Homo sapiens
gcctgcaggtacccggtccggaaattcccgggtcgacccacgcgtccgaaaataagatgaagttagacaactttagattttgtgtggtgtgtacatctatgtgcacagtatgtaaattatcttttattgtattgcttaatagaataaagaagtagaaatttaattcctgtgtgtctatacaatattatagcacatcataaacttaaaaccttatttaaatattcctttctgaattctttcctgtaatcatacatgtatcatcaggtatttgacttgtgctggagtttgaatttgtgatatctgtattctgtagttttatctgaataaaggagaaatatatatgagaaaataaaagtatgaagtaactagttatatgagaaattaatcgtaattctgaacctttattgaaaattgatgttccaaaggttttatctttgg

SEQ ID NO: 3729 - DNA, 551 bp, Homo sapiens
tggtacgcctgcaggtaccggtccggaattcccgggtcgacccacgcgtccggcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaagtaaa

SEQ ID NO: 3730 - DNA, 609 bp, Homo sapiens
ccgcaccaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacgga

SEQ ID NO: 3731 - DNA, 759 bp, Homo sapiens
  misc_feature 498, 730: n = A,T,C or G
ttgaaagaatcactgttataataactttaatttatcttgcattttacagaagtctatgaacgattttaaaaaagcacctccttaccccatatcacgtttctctgacaggtgttaaagtaggcaatgagtatgtcaacagcttgagcatcagcgtcttgcaaggacttcagaccaaccactcgccaaaaatcttggcagcttttttatcttgtttttaatacaacggtatatccactctgatggcaaacctgtccagccacatctccacaacaagctttgcaaaatcagtgattagcaaattagttagctttggcacggagctgtgctcgcttgcccgtgacagcctggaagccggttttgatactggcaacagaacatctagaatgacaagtttcgcactgtaggaaatagagtcgtgtgtccttctgcaggattgtgtccggtgatcggcatgtgtgacaagtgacatattccttgatatatcttctcaagacattntctatctgtttctgttggaatcttcctttgattacaagttggttattaccatctatagaaccacttgtacccaattcagccaacaaaaatgcaaggagatgtttgggctgacgatgtaatagtttacagatatctgtaaagttgacaaaagaagttttcttggttcctactccgacgactggtggaggttcatgacaaatttccttttctcccccacaaccatttctggaancttttccttcatgatgttgaacactcgat

SEQ ID NO: 3732 - DNA, 687 bp, Homo sapiens
gaatttggccctcgaggccaagaattcggcacgaggagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgca

SEQ ID NO: 3733 - DNA, 465 bp, Homo sapiens
tggtacgcctgcaggtaccggtccggaattcccgggtcgacccacgcgtccgagaagatatgaggctaagagaatatcaagtccccaggtctggaagaaaagtagaaaagagtagtacttttaccactttcatgacattggacaatagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtc

SEQ ID NO: 3734 - DNA, 424 bp, Homo sapiens
tggtacgcctgcaggtaccggtccggaattcccgggtcgacccacgcgtccggcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgg

SEQ ID NO: 3735 - DNA, 407 bp, Homo sapiens
tggtacgcctgcaggtaccggtccggaattcccgggtcgacccacgcgtccggccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaattatccagc

SEQ ID NO: 3736 - DNA, 598 bp, Homo sapiens
taccggtccggaattcccgggtcgacccacgcgtccggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgagtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgtgatacactagtttattgaac

SEQ ID NO: 3737 - DNA, 443 bp, Homo sapiens
ctgtgactgtttttctctgtttcacgttcgttgagtgtaagcaatgaaaatgtcccaaataagttttttaagttttactttaataagattaatttcagtaaacattctagttgttcagtgtaacctttttatcttgatgcattgtaagtaaaatgaatcatttactcttgaaatgccagtcattgactgatgtagataatttaggattttcatataaaaatagctgtttaggaaggtgaaatacattcactgtctctgttggtggtacatcttgttgaattcaatattagaaagtatttctttttggggtaatataacttagaattaaatccctgtttctctatgtagtctggcagtataaatataaatatttaccatataatcttggaataagtattagttaatgttaccaaaatctgtattaaataatgttttcaaatgct

SEQ ID NO: 3738 - DNA, 489 bp, Homo sapiens
gctgcttcagagtccagattaaggaaggagaggcctgggcagtcagaaaggaagagaagccggatgtggtggcttgtatcttcaatcccagcactttgagaggccaaggtgggaggatcacttgagcccaggagttcaaaaccagcttgggcaacatagtgagactcccatctctccaaaaaaatttaaaaaccagccaggtagactgggcgcagtggctcacgcctgtaatcccagaactttgggaggccgaggcaggcagatcacgaggtcaagagttagagaccagcctgaccaacatggtgaaaccccgtctctactaaaaatacaaaacttagccaggcctgtggtgatgcgcacctgtagtctcagctactcaggaggctgaggcaggagaatcgcttgaacccgggaggcagaggttgcactgagctgagatcacgccactgcactccagcctgggcaacagagtgagactccgtctcaaac

SEQ ID NO: 3739 - DNA, 420 bp, Homo sapiens
gggcttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacctgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaagccctggctctcctgctgt

SEQ ID NO: 3740 - DNA, 315 bp, Homo sapiens; identical to SEQ ID NO: 340

SEQ ID NO: 3741 - DNA, 493 bp, Homo sapiens
gagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgatgtgaccggtgcccaggcctatgcctccaccgccaagtgcctgaacatctgggccctgattctgggcatcctcatgaccattctgctcatcgtcatcccagtgctgatcttccaggcctatggatagatcacgaggcatcactgaggccaggagctctgcccatgacctgtatcccacgtac

SEQ ID NO: 3742 - DNA, 336 bp, Homo sapiens
ggacagggccgggtccgaggccgcggagctcgcggaggcaaggccgacgataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcataagcagacccgtgccggccagcgcaccaggttcaaggcatttgttgctatcggggactacaatggccacgtcggtctgggtgttaagtgctccaaggaggtggccaccgccatccgt

SEQ ID NO: 3743 - DNA, 369 bp, Homo sapiens
gtctcttttccggttagcgcggcgtgagaagccatgagcagcaaagtctctcgcgacccctgtacgaggcggtgcgggaagtcctgcgcgggaaccagcgcacgcgccgcaagttcctggagacggcggagttgcatatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaataaactcaacatgaataaaaaactggtcaagaagctggccaagaagtatgatgcgtttttggcct

SEQ ID NO: 3744 - DNA, 125 bp, Homo sapiens
cactaagctgtttgccttccaaagtgtttacaccttaagccttaacatgtatcttcattcagaaaacagttatattgtcataccatagtagggaagaaaaacctttatttggaatatacactact

SEQ ID NO: 3745 - DNA, 196 bp, Homo sapiens
ttctgaatgtgatctctcacgcccgtctctggcagaccactgaggaaatccccaacagagagacctactgcccggtcatagaggacaacctaatacagctgtgtaaatctcagattctcaagcatacttctctggccaggaggatctgtgtccaaaactccacgttttctgctacctggaaccgatagtctcttct

SEQ ID NO: 3746 - DNA, 333 bp, Homo sapiens
gagccagcctgacattagacagaataccctttgttatacattaggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctatttcagctttcagatattctagtttgtttcccatggaatctgtcctaaactggtgtttttgtcagtgacagtcttgccagtcagcaattgctaacagcattataaatgagtttgatgtacagtaaatattgatgacaatgaca

SEQ ID NO: 3747 - DNA, 467 bp, Homo sapiens
gactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggac

SEQ ID NO: 3748 - DNA, 446 bp, Homo sapiens
acgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaactttacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaag

SEQ ID NO: 3749 - DNA, 342 bp, Homo sapiens
caggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttttttt

SEQ ID NO: 3750 - DNA, 378 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatga

SEQ ID NO: 3751 - DNA, 355 bp, Homo sapiens
atttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttt

SEQ ID NO: 3752 - DNA, 518 bp, Homo sapiens; identical to SEQ ID NO: 2824

SEQ ID NO: 3753 - DNA, 491 bp, Homo sapiens
gatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaagttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttca

SEQ ID NO: 3754 - DNA, 491 bp, Homo sapiens
gatccctgactcggggtcgcctttggagcagagaggaggtaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagggatcgatacc

SEQ ID NO: 3755 - DNA, 511 bp, Homo sapiens
acagaaggggccctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgt

SEQ ID NO: 3756 - DNA, 497 bp, Homo sapiens
tcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccatcctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctc

SEQ ID NO: 3757 - DNA, 490 bp, Homo sapiens
tagcaggggacctcctcgcccacgacctgccccagcatttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacgga

SEQ ID NO: 3758 - DNA, 487 bp, Homo sapiens; identical to SEQ ID NO: 2786

SEQ ID NO: 3759 - DNA, 523 bp, Homo sapiens; identical to SEQ ID NO: 959

SEQ ID NO: 3760 - DNA, 271 bp, Homo sapiens; identical to SEQ ID NO: 2516

SEQ ID NO: 3761 - DNA, 534 bp, Homo sapiens
acagaaggggggtggtgctgctgctgcttctgaggcactggggctggggcctgtgccttatcggctggaacgagttcatcctgcagcccatccacaacctgctcatgggtgacaccaaggagcagcgcatcctgaaccatgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcatgaaggacaaggtcacccttgtggttggagcgtccccggacatcatcccccagctgaagaagaagtatgatgtggacacactggacatggtcttcctcgaccactgga

SEQ ID NO: 3762 - DNA, 353 bp, Homo sapiens
gaagggcagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaat

SEQ ID NO: 3763 - DNA, 315 bp, Homo sapiens
ctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcaca

SEQ ID NO: 3764 - DNA, 241 bp, Homo sapiens
ggaattgcaaagaacctgctctacgcgcctctcggtgctccaaatggacatcacgaggccagtgcagataaaagatgcttacagcaaggttgcagcaatgctgcaggacagaggactgtgggctgtgatcaacactgctggggtgcttggctttccaactgatggggagcttcttcttatgactgactacaaacaatgcatggccgtgaacttctttggaactgtggaggtcacaaagacc

SEQ ID NO: 3765 - DNA, 401 bp, Homo sapiens
gaagggggagggtagccatgacggcctacgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagag

SEQ ID NO: 3766 - DNA, 335 bp, Homo sapiens
gaaaaaatcaaagcctggtccctagcgaagaaagcgctttaatgtgctcctcccgctcccgggtgcgagattcctgcccagctactaggccacgactggctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatcccaccttggacaacctccagaagggagtccaatttgctctcaagtaccagtcgctgggccagtgtgtttacgtgcattgtaaggctgggcgctcc

SEQ ID NO: 3767 - DNA, 444 bp, Homo sapiens
gagtcagtctcagtcaggacacagcatggacatgggggtccccgctcagctcctggggctcctgctactctggctccgaggttccagatgtgacatccagatgacccagtctccctcctccctgtctgcatctgtgggagacagagtcatcatgacttgccggacaagtcactatataagcagttatttaaattggtatcagcagataccagggacagcccctaagctcctgatctatgctgcatccagtttgcaaagtggggtcccatcaaggttcagtggcagtggatctgggacaaatttcactctcaccatcagcagtctgcaacctgaagattttgcaacttattactgtcaacagttttatagtaccattattaatttcggcccagggacacgactggagattcaacgaactgtggctgcaccatctgtcttcatctt

SEQ ID NO: 3768 - DNA, 210 bp, Homo sapiens
gaagggggttttgcagacgccaccgccgaggaaaaccgtgtactattagccatggtcaaccccaccgtgttcttcgacattgccgtcgacggcgagcccttgggccgcgtgtgctttgagctgtttgcagacaaggtcccaaagacagcagaaaattttcgtgctctgagcactggagagaaaggatttggttataagggttcctgcttt

SEQ ID NO: 3769 - DNA, 462 bp, Homo sapiens
ggttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtg

SEQ ID NO: 3770 - DNA, 456 bp, Homo sapiens
accaaaaggatttatatgtactgttgacaccataaaagattctgacgaagagctggacaacaatcagatagaagtactggaccagccaatcaataccacagacctgcctttccacattgactggaatgatgatcttcctctcaacattgaggtccccaaaatcagcctccacagcctcattctcgacttttcagcagtgtcctttcttgatgtttcttcagtgaggggccttaaatcgattttgcaagaatttatcaggatcaaggtagatgtgtatatcgttggaactgatgatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggaaaaagatggaaaaattga

SEQ ID NO: 3771 - DNA, 285 bp, Homo sapiens
ccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatctttttttttttttttccggggggggggggggggggggg

SEQ ID NO: 3772 - DNA, 375 bp, Homo sapiens
gagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctg

SEQ ID NO: 3773 - DNA, 461 bp, Homo sapiens
gcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctat

SEQ ID NO: 3774 - DNA, 465 bp, Homo sapiens
caccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtgagaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaactagtgcccttgtatagtgtccccat

SEQ ID NO: 3775 - DNA, 382 bp, Homo sapiens
tataatatcttggcagccaggagtggtggctcacacctgtaatcccaggactttgggaggctgagatgggcagatcacctgaggtcaggagtttgagaccagcctggccaacatggtgaaactccgtctctactaaaaatacaaaaattagctgggcttggtggcgtgtctgtaatcccagttacttgggagtctgaggaaggagaattgcttgaacctgggaggcgcaggttgcagtgagccgagactgtgccactgccctccaacctgggcaacagagtaagaccctgtctcaaaaaataaataaataaaacaaaagaatgtacaaacatgtacaattgaaaaacctgatagaagaggccaggcatggtagctcatgcct

SEQ ID NO: 3776 - DNA, 336 bp, Homo sapiens; identical to SEQ ID NO: 961

SEQ ID NO: 3777 - DNA, 374 bp, Homo sapiens
gactggaggcactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagc

SEQ ID NO: 3778 - DNA, 463 bp, Homo sapiens
gggtagtgagaacccttccggtgggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaag

SEQ ID NO: 3779 - DNA, 520 bp, Homo sapiens
gggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagcggtccccagcactgcagatccgcacagttctgctatcgatccaggcctcgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtg

SEQ ID NO: 3780 - DNA, 430 bp, Homo sapiens
ctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttatgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagc

SEQ ID NO: 3781 - DNA, 431 bp, Homo sapiens
tattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatactaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagagtcggaaa

SEQ ID NO: 3782 - DNA, 534 bp, Homo sapiens; identical to SEQ ID NO: 964

SEQ ID NO: 3783 - DNA, 570 bp, Homo sapiens
gaatttggccctcgaggccaagaattcggcacgaggcgccagccaatgagatgacgcgggcagagttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaaccc

SEQ ID NO: 3784 - DNA, 623 bp, Homo sapiens
gaatttggccctcgaggccaagaattcggcacgagggactttctgaaaagtgatgagggcaggggcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgccc

SEQ ID NO: 3785 - DNA, 592 bp, Homo sapiens
gaatttggccctcgaggccaagaattcggcacgaggcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggccgtctctgaggagtacctcgacctccgcctgaccttcggaccctattccccctctggtggggacgccagcagcacctgctcctccagcgattctgtcttcagcca

SEQ ID NO: 3786 - DNA, 481 bp, Homo sapiens
accgagacatcaagcctgccgacgtgtgcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttac

SEQ ID NO: 3787 - DNA, 381 bp, Homo sapiens
gcttactttccaacttggacgctgcataatggctcccgcacagaagggtggctagaacaaaaagggccgttctgccatcaacgaagtggtaacccgagaatacaccatcaacattcacaagcgcattcatggagtggactcgaataagcgtgcacctcgggcactcaaagagattcggaaatctgccatgaaggagatgggaactccagatgtgcgcattgacaccaggctcaacaaagctctctgggccaaaggaataaggaatgtgccataccgaatccgtgtgcggatgtccaaaacacgtgctgatgatgaagattcaccaagtaagctatatactcttggttacctatgtacctgttaccactttcaaaagtaagt

SEQ ID NO: 3788 - DNA, 86 bp, Homo sapiens
aacccttcagtcagcacgtgagaaaactgcgagccagcattacccccgggaccattctgatcatcctcactggacgccacaggggc

SEQ ID NO: 3789 - DNA, 344 bp, Homo sapiens
gtctctttccagccagcgccgagcgatgggcatctttcgggacaactggcacaagcgccgcaaaaccggtggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtataacaaggatcatcgatgttgtctacaatgcatctaataacgagctggttcgtaccaagaccctggtgaagaattgcatcgtgctcatcgacagcg

SEQ ID NO: 3790 - DNA, 474 bp, Homo sapiens
tgcatttaactacaaaaaaagtttatgtttacttaggtagaggtgttatgtataatgctttgttaaagaaccccctttccgtgccactggtgaatatggattgatgaatggaaagagtttagtcaaaccagtaaacccgtcctggattccttgaacatgttcccatgtatgaggtaaaaccaattctggaagtgtctatcaactttcataaataactttaattttagtataatgatggtcttggattgtctgacctcagtagctattaaataacttcaagtaacttctgtatcatgccctacatagaacatacagttgagtgggagtcaacaaaaagataaacatgcgtgttaatggctgttcgacagaaatctgaataaaagcctaaacaggaactacttcatcacagtgttgatgttggacacatagatggtgatggcacacgtttataacacattattttcaaagactaaa

SEQ ID NO: 3791 - DNA, 320 bp, Homo sapiens
caagtggggcatgagccggaagatctggcgaagcttaggcaaaaacaccaccaatcacgtggaagttaattttataaaaaaatttacgtcagaaagagattttcacccatccatcagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagt

SEQ ID NO: 3792 - DNA, 347 bp, Homo sapiens
  misc_feature 340: n = A,T,C or G
atgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagcgattctaagatttggtttgggatcaataggaaagcatatgcagccaaccaagatgcaaatgttttgaaatgatatgaccaaaattttaagtaggaaagtcacccanacacttt

SEQ ID NO: 3793 - DNA, 338 bp, Homo sapiens
ctaaatccatgaagtttgtggatggcctgatgatccacagcggagaccctgttaactactacgttgacactgctgtgcgccacgtgttgctcaaacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctct

SEQ ID NO: 3794 - DNA, 343 bp, Homo sapiens
ataaccaagcataatataggcaaggactaacccctataccttctgcataatgaattaactagaaataactttgcaaggagagccaaagctaagacccccgaaaccagacgagctacctaagaacagctaaaagagcacacccgtctatgtagcacaatagtgggaagatttataggtagaggcgacaaacctaccgagcctggagatagctggttgtccaagatagaatcttagttcaactataaatttgcccacagaaccctataaatccccttgaaaatttaactgttagtccaaagaggaacagctctttggacactaagaaaaaaccttgccgagagag

SEQ ID NO: 3795 - DNA, 194 bp, Homo sapiens
ggggtggcggcgacgacccattcgaacgtctgccctatcaactttcgatggtagtcgccgtgcctaccatggtgaccacgggtgacggggaatcacggttcgattccggagagggagcctgagaaacggtaccacatccaaggaaggcagcaggcgcgcaaattacccactcccgacccggggaggtagtgacg

SEQ ID NO: 3796 - DNA, 313 bp, Homo sapiens
tccttcaacaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggag

SEQ ID NO: 3797 - DNA, 402 bp, Homo sapiens; identical to SEQ ID NO: 967

SEQ ID NO: 3798 - DNA, 222 bp, Homo sapiens
ttctgcctcagcctcccaagcagctgggactacaggcacatgccgccacacctggctaattttttgtattttaatacagacggggtttcactgtgtcacccaggctggtctcgaactcctgagctcaggcaatccacctgcctcggcctcccaaagtgctgcgattacaggcgtgagccaccgtgcccagccttacttagatatcttataggcacctcaaat

SEQ ID NO: 3799 - DNA, 442 bp, Homo sapiens; identical to SEQ ID NO: 968

SEQ ID NO: 3800 - DNA, 284 bp, Homo sapiens
gcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccgtgataattctttgtatataaaataaacattcg

SEQ ID NO: 3801 - DNA, 419 bp, Homo sapiens
agcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactc

SEQ ID NO: 3802 - DNA, 449 bp, Homo sapiens
aggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcat

SEQ ID NO: 3803 - DNA, 405 bp, Homo sapiens; identical to SEQ ID NO: 970

SEQ ID NO: 3804 - DNA, 494 bp, Homo sapiens
accgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgct

SEQ ID NO: 3805 - DNA, 524 bp, Homo sapiens
ggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttga

SEQ ID NO: 3806 - DNA, 532 bp, Homo sapiens
cagaagggactctagaggagaccaaggcccgttacagcagccagttagccaacctccagtcgctgttgagctctctggaggcccaactgatgcagattcggagtaacatggaacgccagaacaacgaataccatatccttcttgacataaagactcgacttgaacaggaaattgctacttaccgccgccttctggaaggagaagacgtaaaaactacagaatatcagttaagcaccctggaagagagagatataaagaaaaccaggaagattaagacagtcgtgcaagaagtagtggatggcaagggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggttggggtggcgggaatcctatttatcagactctgtaattgaatataaatgttttactcag

SEQ ID NO: 3807 - DNA, 513 bp, Homo sapiens
gggagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgt

SEQ ID NO: 3808 - DNA, 79 bp, Homo sapiens
gaggtggttatgacaactatggagtaggaaattatggaagtggaaattacaatgattttggaaattataaccagcaacc

SEQ ID NO: 3809 - DNA, 509 bp, Homo sapiens
accgaagggtcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttc

SEQ ID NO: 3810 - DNA, 410 bp, Homo sapiens
agcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttga

SEQ ID NO: 3811 - DNA, 466 bp, Homo sapiens
gagcggtagcgatggacactctggatcgagtagtaaagcccaaaacgaaaagagccaagagattccttgagaagagagaaccgaaactcaatgaaaatgttaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgt

SEQ ID NO: 3812 - DNA, 314 bp, Homo sapiens
gcacagctgaagttttcaagaagcatggagtgtacaaccccaacataatcttcggcgtgacgaccctggacatcgtcagagccaacacctttgttgcaaagctgaagggtttggatccagctcgagtcaacgtccctgtcattggtggccatgctgggaagaccatcatacccctgatctctcagtgcacccccaaggtggactttccccaggaccagctgacagcactcactgggcggatccaggaggccggcacggaggtggtcaaggctaaagccggagcaggctctgccaccctctccatggcgtatgcc

SEQ ID NO: 3813 - DNA, 472 bp, Homo sapiens
agaggtaggaaggacagcagagctgacagtcacagcagccctgacaagagagttcctggagcccaagctcttctccacagaggacaagcaggcagcagagaccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacgatcgagagacaatataccccaatggaaccctgctgatccagaacgtcacccacaatgacgcaggaatctatacccta

SEQ ID NO: 3814 - DNA, 463 bp, Homo sapiens
cagctaacctcaccctccacccctcaatgtagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaatcgcctctacatcaccacgtcgctgtacagtgcctgggacaagcagttttaccctgatctcatcagggaaggctctgtgatgct

SEQ ID NO: 3815 - DNA, 391 bp, Homo sapiens
gctttccggacctggaagagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccgaatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaag

SEQ ID NO: 3816 - DNA, 468 bp, Homo sapiens
aaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatag

SEQ ID NO: 3817 - DNA, 463 bp, Homo sapiens
acctctagcatcaccagtattagaggcaccgcctgcccagtgacacatgtttaacggccgcggtaccctaaccgtgcaaaggtagcataatcacttgttccttaagtagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaata

SEQ ID NO: 3818 - DNA, 435 bp, Homo sapiens
ggtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaag

SEQ ID NO: 3819 - DNA, 269 bp, Homo sapiens
actggctgtcgcttgtcttctattcaccatggcttcttctgatatccaggtgaaagaactggagaagcgtgcctcaagccaggctttggagctgattctcagccctcggtcaaaagaatctgttccagacttccccctttcccctccaaagaagaatgatctttccctggaggaaattcatatgaaattagaagctgcagaagaaagacgcaagtcccatgaagctgaggtcttgaagcagctggctgagaaacgagagcacgagaaag

SEQ ID NO: 3820 - DNA, 253 bp, Homo sapiens; identical to SEQ ID NO: 2557

SEQ ID NO: 3821 - DNA, 392 bp, Homo sapiens
gctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtg

SEQ ID NO: 3822 - DNA, 347 bp, Homo sapiens
gctaaacctagccccaaacccactacaccttactaccagacaaccttagccaaaccatttacccaaataaagtataggcgatagaaattgaaacctggcgcaatagatatagtaccgcacgggaaagatgaaaaattataaccaagcataatatagcaaggactaacccctataccttgtgcataatgaattaactagaaataactgtgctaggagagccaaagctaagacccccgaaaccagacgagctacctaagaacagctaagagagcacacccgtctatgtagcacaatagcgggaagatttataggtagaggcgacatacctaccgagcctggagatagct

SEQ ID NO: 3823 - DNA, 434 bp, Homo sapiens; identical to SEQ ID NO: 978

SEQ ID NO: 3824 - DNA, 500 bp, Homo sapiens
attaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataactt

SEQ ID NO: 3825 - DNA, 554 bp, Homo sapiens
gcatgaggcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatca

SEQ ID NO: 3826 - DNA, 470 bp, Homo sapiens
gacagaagggggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaatgctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaact

SEQ ID NO: 3827 - DNA, 441 bp, Homo sapiens
ctagtctttccgcttcttgaatttctctctgtaaaggagatatataatgaaaaggaattattacaaggtaaattaccttcttagtgataccaacatggtagactgtgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtacgatgctctttgactacctggcggacaagcatggttttaggcaggaatatttagatacactctacagatatgcaaaattccagtacgaatgtgggaattactcacgagcagcagaatatctttatttttttagagtgctggttccagcaacagatagaaatgc

SEQ ID NO: 3828 - DNA, 424 bp, Homo sapiens
gagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaa

SEQ ID NO: 3829 - DNA, 253 bp, Homo sapiens
agccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttgcaccccatgctgttg

SEQ ID NO: 3830 - DNA, 368 bp, Homo sapiens
gtggaccagatccacatcaaaccgggggctaaggttctctacctcggggctgcctcggtcaccacggtctcccatgtatctgacatcgttggtccggatggtctagcctatgcagtcgagttctcccaccgctctggccgcgacctcattaacttggccaagaagaggaccaacatcattcctgtgatcgaggatgctcgacacccacacaaataccgcatgctcatcgcaatggtggatgtgatctttgctgatgtggcccaaccagaccagacccggattgtggccctgaatgcccacaccttcctgcgtaatggacgacactttgtgatttccattaaggccaactgcattgactacacagcctc

SEQ ID NO: 3831 - DNA, 281 bp, Homo sapiens; identical to SEQ ID NO: 985

SEQ ID NO: 3832 - DNA, 472 bp, Homo sapiens
gcctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggct

SEQ ID NO: 3833 - DNA, 509 bp, Homo sapiens
ttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgc

SEQ ID NO: 3834 - DNA, 341 bp, Homo sapiens
gagagtcggctcaatctggtgcagagaaatgttaatgtcttcaaattcattattcctcagatcgtcaagtacagtcctgattgcatcataattgaggtttccaacccagtggacattcttacgtatgttacctggaaactaagcggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagaggtgagaatgtggcaggtgtttctctccaggaattgaatccaga

SEQ ID NO: 3835 - DNA, 411 bp, Homo sapiens; identical to SEQ ID NO: 986

SEQ ID NO: 3836 - DNA, 338 bp, Homo sapiens
gctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcga

SEQ ID NO: 3837 - DNA, 331 bp, Homo sapiens
atatgcccacgtcaagacgcttgtgtcagattataagataggttcggcgcagtggcttacacctgtaatcctagcactttgggaggctgaggtgggtggatcacctgaggtcaggaatttgagaccagcctgacgaatatggtgaaaccccatctctactaaaaatacaaaaattagctaacttagctgggcgtggtagcctgcacctgcagtcccagctagtcgggaaactgagacaagagaattgcttaaacttgggatgcagaggttgcagtgagccgagatagcgccactgcactccagcctgggtgacagagcgagactccatctc

SEQ ID NO: 3838 - DNA, 86 bp, Homo sapiens
gattaactgaagaagatagggttgatttataaagtttgaattcgaggccaggcacagtggctcatgcctgtaatcccagcacttta

SEQ ID NO: 3839 - DNA, 401 bp, Homo sapiens
tcttaggtgggaagactacaaggcttgcaaagcccatgagctcagccccagctctgctctgcaaaggctgtgaggcctgttgcttaacctctctgaatcttctaggccttagaatgactcaaagtggggccaggcgcggtggctggtaattccagcactttgggaggccgaggtgggcagatcacgaggtcaggagatcgagaccatcctgggtaacacagtgaaacccgtctctactaaaaatacaaaaaattagccaggtgttatagcatgcgcctgtagtcccagctactgaggctgaggcaggagaatcgcttgaactcaggaggcacaggttgcagtgagccaagatcgtgccactgcaatccacagcctgggcgacagagcgagacttggtcttt

SEQ ID NO: 3840 - DNA, 484 bp, Homo sapiens
cgctgcgaaaagacacaccaaaggggggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaacccatcaagaagtggaaggctgaccatgatgagcagtagatgaatgtgtatgtctaaacaaggactgctctgtgtcctcacagatgaatgag

SEQ ID NO: 3841 - DNA, 475 bp, Homo sapiens
acagaagggaactaaattactgtattcttcaactaatgggacacaatattcttttttttcttttttgagacagagtctcactctgtcgcccaggctggagtgcagtggcatgatctcagctcactgcaacctccacttccagggttcaagctattctcctgcctcagcctccaaagtagctgggattacaggcacgtgccaacacgcctggctaatttttgtattttcagtggagacggggtttcactgtgttagccaggatggtctcgatctcccgacctcatgatccacctgcctcggcctcccaaagtgctgggattacaggcatgagccaccgcgcctggccgtaatatcctttttttaatcccacttggaaatcacaaaggaagcattactaaattatgatttaattctgcatagttaatggaaaaatattttgccatgttttcaccttattacattttctcaatatcag

SEQ ID NO: 3842 - DNA, 237 bp, Homo sapiens
acagaaggggaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaaggg

SEQ ID NO: 3843 - DNA, 468 bp, Homo sapiens
gcttttccggacctggccgagcaggaggcgccatcatgggagtggacatccgccataacaaggaccgaaaggttcggcgcaaggagcccattagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagg

SEQ ID NO: 3844 - DNA, 235 bp, Homo sapiens
gaagctggactgggcccgcgagaggcttgtgcagcaggtacctgtgaaccaagtgtttgggcatgatgagatgatcgacgtcatatgggagaccaagggcaatggctacaaaggggtcaccagtcgttggcacaccaagaagctgccccgcaagacccaccgatgcctgcgcaaggtggcctgtattgcggcatggcatcctgctcgtgtaaccttctctgtgtcacgcgctggg

SEQ ID NO: 3845 - DNA, 416 bp, Homo sapiens
atacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagc

SEQ ID NO: 3846 - DNA, 324 bp, Homo sapiens
gcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcg

SEQ ID NO: 3847 - DNA, 480 bp, Homo sapiens
acgacagaagggcctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtct

SEQ ID NO: 3848 - DNA, 254 bp, Homo sapiens
acctaccggattcaagcgattctcatgcctcagtctgctgagtagctaggatttacaggtgcccaccaccatgcccggctaatttttttgtatttttagtagagatgggatttcaccatgttggccaggctggtctcaaactcctgagcttaggtgatccatctgccttggccccacaaagtgctgggattacaggtgtgagccacctcgccctgccaggtttatttattcttgagagggagtcttgccctgtt

SEQ ID NO: 3849 - DNA, 444 bp, Homo sapiens
gaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagttttcttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaa

SEQ ID NO: 3850 - DNA, 222 bp, Homo sapiens
gactggtgttctcaaacccggtatggtggtcacctttgctccagtcaacgttacaacggaagtaaaatctgtcgaaatgcaccatgaagctttgagtgaagctcttcctggggacaatgtgggcttcaatgtacagaatgtgtctgtcaaggatgtacgtcgtggcaacgttgctggtgacagcaaaaatgacccaccaatggaagcagctggcttcactgc

SEQ ID NO: 3851 - DNA, 448 bp, Homo sapiens
aagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatctccttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttgga

SEQ ID NO: 3852 - DNA, 520 bp, Homo sapiens
ttcgtaaatttagggatcttcccaaaatgtggagtattagtagaatggatacagttatctggtttgttactatgctgtcctctgcactgctaagtactgaaataggcctacttgttggggtttgtttttctatattttgtgtcatcctccgcactcagaagccaaagagttcactgcttggcttggtggaagagtctgaggtctttgaatctgtgtctgcttacaagaaccttcagactaagccaggcatcaagattttccgctttgtagcccctctctactacataaacaaagaatgctttaaatctgctttatacaaacaaactgtcaacccaatcttaataaaggtggcttggaagaaggcagcaaagagaaagatcaaagaaaaagtagtgactcttggtggaatccaggatgaaatgtcagtgcaactttcccatgatcccttggagctgcatactatagtgattgactgcagtgcaattcaatttttagatacagcagggatccacacactgaa

SEQ ID NO: 3853 - DNA, 503 bp, Homo sapiens
gagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacact

SEQ ID NO: 3854 - DNA, 414 bp, Homo sapiens
aagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagt

SEQ ID NO: 3855 - DNA, 443 bp, Homo sapiens
attgggggctattgtctgtatcagtggacgtaaaaaggcaaatgcggcatgtcctaacttacaagaggggctaaataataggtacacatggacatagaatgtgaggctaggtgcagtggctcactcctataatcccagcactttggaaggccgaggtgggcagatcacttgaggccaggagttcgagaccagcctggtcaacatggtgaaaccctgtctctactaaaaatacaaaaatgagcctggtgtagtggcgggtgcctgtaatcccagttactagggaggctgaggcacgaaaatctcctgaacccaggaggcagagattactgtgagctgagattgcgccactgcactccagcctagacgacagagtgagactctgtctcaaaacaaacaagcaaaaacatggtcatagagtgtgaaataacagacactggagactc

SEQ ID NO: 3856 - DNA, 214 bp, Homo sapiens
acacattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaac

SEQ ID NO: 3857 - DNA, 346 bp, Homo sapiens
aaccactagaggccgggcattgtggctcatgcctgtaatcccagcactttgggagaccaaggcaggcggattgcctgaggtcagaagtttgagaccagcctggccaacatagtgaaaccccatctctactaaatatacaaaaaaaattagccaggtgtgctggtgggcacctgtagtcccagctattcaagaggctgaggcaagagaatcccttgaacctgggaggcggaggttgcagtgagccgagattgtgccactgcactccagcctggtgacagagtgagactccgtctcaaaaaaaacaaaacaaaaacaaaaaaaccccactagatagaggtagaaatgg

SEQ ID NO: 3858 - DNA, 368 bp, Homo sapiens
tacggctgttagaagactacagaagggggccgaggcaggcggatcacctttggtcaagagttccgacaccagcctcgccaacatagtgaaatcccatctctactaaagatacaaaaattagctgggcatggtggtacatgcctgcagttccagctactcaagaggctgaggcaggagaatggcttgaacccaggaggcggaggttgcagtgagccaagatcatgccactgcactccaacctgggagatagagcgagactctgtctcaaaattaagaaacattagcacttaaactagaagaacgaatgaaatccacggcaagcagaaggaacaaggttgaaaagcagaaatcaatgaatcagaaaacag

SEQ ID NO: 3859 - DNA, 419 bp, Homo sapiens
tgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcattatgtctgcagatgtaccccttgttgtagagtataaaattgcggatatgggacacttaaaatactacttggctccca

SEQ ID NO: 3860 - DNA, 466 bp, Homo sapiens
ggtgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaattggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactg

SEQ ID NO: 3861 - DNA, 440 bp, Homo sapiens
ttaggaaaaaccaattcttcttaaatttagttcatctttctttaaaagaacattaaatgtaaccattttgtcagatccatgtattttggagcataaaatgtatgctggtgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcaatgatcagaagcagcagttatttgagtgtatgaatggaatgatgatcactgtgctataatgtactgaaaccaccatattacagaaatatttactacatatttt

SEQ ID NO: 3862 - DNA, 406 bp, Homo sapiens
gctctctcgagtcactccggcgcagtgttgggactgtctgggtatcggaaagcaagcctacgttgctcactattacgtataatccttttcttttcaagatgcctgaggaagtgcaccatggagaggaggaggtggagatttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttggg

SEQ ID NO: 3863 - DNA, 533 bp, Homo sapiens
gttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttactt

SEQ ID NO: 3864 - DNA, 480 bp, Homo sapiens
caggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggcgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaac

SEQ ID NO: 3865 - DNA, 318 bp, Homo sapiens; identical to SEQ ID NO: 987

SEQ ID NO: 3866 - DNA, 479 bp, Homo sapiens
gcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaata

SEQ ID NO: 3867 - DNA, 232 bp, Homo sapiens; identical to SEQ ID NO: 988

SEQ ID NO: 3868 - DNA, 477 bp, Homo sapiens
gagggtgagctctgcccggctgcagggatggcggggaggggtaagctcatcgcagtgatcgggacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgattt

SEQ ID NO: 3869 - DNA, 372 bp, Homo sapiens
ggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaat

SEQ ID NO: 3870 - DNA, 322 bp, Homo sapiens
gggtgccgaggctcacgcctgtaatcccagcactttgggaggccaaggcaggcggagcacaaggtcaagagatcgagaccatcctggctaacacggtgaaaccccgtctctactaaaaatacaaaaacttacccgggtgtggtggtgggtgcctgtagtcccagctactagggaggctgaggcaggagaatggcttgaacccgggaggcggagcttgcagtgagccaagatcgcgccaccgcactccagcctgggtgacagagcaagacctccatctcaaaaaaaaaatacatgcagggccgggggcagaggctcacgcctg

SEQ ID NO: 3871 - DNA, 70 bp, Homo sapiens
agctgacgcaaacatgcagatctttgtgaagaccctcactggcaaaaccatcacccttgaggtcgggccc

SEQ ID NO: 3872 - DNA, 61 bp, Homo sapiens
tatctcatttggtctcagagctgtgaatcagccagcaatattttagttgcaaatcactgaa

SEQ ID NO: 3873 - DNA, 377 bp, Homo sapiens; identical to SEQ ID NO: 2896
  misc_feature 349: n = A,T,C or G

SEQ ID NO: 3874 - DNA, 424 bp, Homo sapiens
ggcttcctgcttcgcctccgcgcctcgcgctatgggacagagcccccgatccgccagcaccacctgaggatccagaaaccgccccggcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattccctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttga

SEQ ID NO: 3875 - DNA, 422 bp, Homo sapiens
tggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtca

SEQ ID NO: 3876 - DNA, 57 bp, Homo sapiens
ctcttgaaaggacacagttgtactaccccgcaatgcaaatgcctgcttgcgaaatgt

SEQ ID NO: 3877 - DNA, 434 bp, Homo sapiens
ggtcgagaagcagctacccaagctccaggagcttccgaagaaacaggaccagagagggaaggtgacctgaaagtcacagaataattttttagagctgaacaagaatccaagcctggaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatatt

SEQ ID NO: 3878 - DNA, 459 bp, Homo sapiens
gtacgggaaggcgaagaggagatagagaagatagggaaattagaagataaaaacatacttttagaagaaaaaagataaatttaaacctgaaaagtaggaggcagacgaaaaaagacaggctatgaaacaaaaagctaagggcaaaatgtacaaacttagaagaaaattggaagatacaaacaagatggaaaatgaagatattgacaggagtttcagatagaaaatgaacaacaagctaagacatgtattggagaagtatagaagatagagaaatgtaaagccaagaattggatgaaatagcactgaaaaaatgaggagattattggtaaccaatctattttaaaagcccatcaatttaatttctggtggtgcagaagttagaaggcaaagcttgagaagatgagggtgtttacgtagaccagaaccaatttagaagaatacttgaagctagaaggggaa

SEQ ID NO: 3879 - DNA, 460 bp, Homo sapiens
caaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctacacagactccgccagagacacctagtcctgatgaaacgtctgctccttgtcctaatattcatatcaacagcaccattcctggcattcacattttaaaaattatgtggaagtggataggag

SEQ ID NO: 3880 - DNA, 446 bp, Homo sapiens
ggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagggtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaac

SEQ ID NO: 3881 - DNA, 292 bp, Homo sapiens
tatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttc

SEQ ID NO: 3882 - DNA, 349 bp, Homo sapiens
  misc_feature 349: n = A,T,C or G
gagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttn

SEQ ID NO: 3883 - DNA, 349 bp, Homo sapiens; identical to SEQ ID NO: 3882
  misc_feature 349: n = A,T,C or G

SEQ ID NO: 3884 - DNA, 292 bp, Homo sapiens
gaaggggcctgggtgacagagtgagactccacctcaaaaataaccccatctctactaaaaatacaaacttagccgagcatggtggtgcatgcctgtaatcctagctattcgggaggctgaggcaggagaatcgtttgaacccgggaggcagaggttgcagtgagctgagatcatgccaccgcactctagcctggacaacaagagggaagctgcctctgaataaaaaaagaaaaataatttgaaacggtgcccagtcccaaaatgtttaaatctacctattacctgggagcgt

SEQ ID NO: 3885 - DNA, 504 bp, Homo sapiens
gcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgtcattattattt

SEQ ID NO: 3886 - DNA, 464 bp, Homo sapiens
ataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaagagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacag

SEQ ID NO: 3887 - DNA, 360 bp, Homo sapiens
gcctttttgctgtaagcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacacggtactctgtggatatccccttggacaaaactgtcgtcaataaggatgtcttcagagatcctgctcttaaacgc

SEQ ID NO: 3888 - DNA, 355 bp, Homo sapiens; identical to SEQ ID NO: 990

SEQ ID NO: 3889 - DNA, 426 bp, Homo sapiens
gagatggagtctcactgtgacacccaggctggagtgcaatggcgctgtctcggctcactgcaacctcctcctcccgggttcaagcgattctccagcttcagcctcctgagcagctgggattacaggcgcccgccaccacgcccggctaatttttgtatttttagtagagacgggggtttcaccacattggtcaggctagtcttgaactcctgacctcaagtgatctgcccgcttcgacctcccaaagtgctgggattacaggcgtaagccatcgcaccccaccattctagtttttttttttggagacagggtctctgtcgcccaggctggaatggcagtgggcagtggcacaccctcctccactattgcctgtctggcccaaactagtgtcatctttcctctcagcaccacagcctcctctttggt

SEQ ID NO: 3890 - DNA, 591 bp, Homo sapiens
tcggcacgaggctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctca

SEQ ID NO: 3891 - DNA, 598 bp, Homo sapiens
ggaatttggccctcgaggccaagaattcggcacgagccaggctttaggtatcaccacggaaaggtccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttag

SEQ ID NO: 3892 - DNA, 311 bp, Homo sapiens
gctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgc

SEQ ID NO: 3893 - DNA, 458 bp, Homo sapiens
gggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtatatttactgtttgtgagaggagctggaaactgccctgagtgtggtactccactcagaaagggcaacttcagggtacaactctttgaagatcccactgttgacaaggaggttgacatcaggaaaaaagtgctaaagatatacaataaaagggaagaagatcttcctagtctaagagaatacaatgatttcttggaagaagtggaagaaattgttttcaacttgaccaacaatgtggatttggacaacaccaaaaagaaaatg

SEQ ID NO: 3894 - DNA, 428 bp, Homo sapiens
gggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacct

SEQ ID NO: 3895 - DNA, 508 bp, Homo sapiens
gtgcacttactttcatattttgcagctgttaatagaagtcttaaacatttaaaatttaactaattcacacaacctccaccaagtatcagtaaataaacttctaaacaataaaaatggataaacatggtcaggttgttaggttaagagctaaaaatttcattttgcttccatggttgcaaccatgagtcttaaggccttcaaagcataaacatcacagaacacctatcacaaaccacaaaccaaccacgggaaaaccctttttatactgtgtatcttctgtatttcattaaacctaataagccatcagttgtaagatgcatcctaattcagagatgtcacaaagtgaaataagtatctctggatcaataaaatatggtatgtatatatacccgagatatgagaggaaactatttaccagtttgaattacttccatactattgtgccaaacaacaattaagtgtcaaaacattgaaattttatgtaggtaagctttttattattggtttc

SEQ ID NO: 3896 - DNA, 226 bp, Homo sapiens
gggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatga

SEQ ID NO: 3897 - DNA, 158 bp, Homo sapiens
ggtcttccggtctttctggtctcggccgcagaagcgagatgacgaagggaacgtcatcgtttggaaagcgtcgcaataagacgcacacgttgtgccgccgcttgggctctaaggcctaccaccttcaaaagtcgacctgtggcaaatgtggctaccct

SEQ ID NO: 3898 - DNA, 403 bp, Homo sapiens
ggattctgctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttataaa

SEQ ID NO: 3899 - DNA, 116 bp, Homo sapiens
ggcggcgacgacccattcgagcgtctgccctatcaactttcgatggtagtcgccgtgcctaccatggtgaccacgggtgacggggaatcacggttctattccggagagggagcctg

SEQ ID NO: 3900 - DNA, 62 bp, Homo sapiens
tcaccattacaggccatgctgagacaaagcagctgacagaaatgctacccagcatcttaaac

SEQ ID NO: 3901 - DNA, 411 bp, Homo sapiens
gggcttctttttaatttaagcatctgcagctgtaagcttccctttagcatgggtttgagatctttcttctttttaatttaaggatctgtagctgtaagcttccctttagcatgggtttgagatctttcttctttttaatttaagcatctggagctgtaagcttccctttagcactgcctttgttgcctcctcctgagtttgggtatgtcatggtttcgttttcatttgcttaaacattttttgtcctattgtaatataattgtgttgtttttaataaaggtaattaatgaaacacataatgaattgtacttctgtttttataacattttaagcattcttaactcagaaatgtaaattttagaaaaaaattccaggccaggcacagtggctcacacctgtaatcccagcact

SEQ ID NO: 3902 - DNA, 215 bp, Homo sapiens
gtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttatcaacacaaatcagttggaaaattatggtttgagtcctgttgctgccatggcttct

SEQ ID NO: 3903 - DNA, 467 bp, Homo sapiens
gacacagtgctggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttg

SEQ ID NO: 3904 - DNA, 422 bp, Homo sapiens
gtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctattttagctttcagttattctagtttgtttcccatggaatctgtcctaaactggtgtttttgtcagtgacagtcttgccagtcaacaatttctaacagcattttaaatgagtttgatgtacagtaaatattgatgacaatgacagc

SEQ ID NO: 3905 - DNA, 512 bp, Homo sapiens; identical to SEQ ID NO: 995

SEQ ID NO: 3906 - DNA, 274 bp, Homo sapiens
gctttttttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagg

SEQ ID NO: 3907 - DNA, 499 bp, Homo sapiens
cagaaggggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctgggtcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattga

SEQ ID NO: 3908 - DNA, 442 bp, Homo sapiens
gattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtg

SEQ ID NO: 3909 - DNA, 328 bp, Homo sapiens
tgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaagtaactgaaatgaaccagacacactgattggaactgtattatattaaaatactaaaaatc

SEQ ID NO: 3910 - DNA, 365 bp, Homo sapiens
gagctcgcccaccgcccgccccagcagtggctgcaccatgcacgtgaacggcaaagtggcgctggtgaccggcgcggctcatggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaatgatgagaaaaactgggaaaaaactctgcaaattaatttggttt

SEQ ID NO: 3911 - DNA, 469 bp, Homo sapiens
caagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatga

SEQ ID NO: 3912 - DNA, 410 bp, Homo sapiens
aatgggggcctcaaagatagtaatttcttatgtcctaagctagggggtatgcatatgggagttcgttttattgccattctgtatgactcacacatgtcagaaatattctttggtcttgtattttaaaatacaagtgggccaggtgtggtggctcacacctgtaatcccagcactttgggaggccgagtcaagcggatcatctgaggtcaggagttcaagaccagcctggccaacatggtgaaaccccgtctctactaaaaatagaaaaattagctgggtgtggtggcacacacctgtaaccccttgggagactgagggaggagaatcccttgaacccaggaggtggaggttgcagtcagctgagattgcgccactgcactccagcctgggtgacagagtgagactctgtc

SEQ ID NO: 3913 - DNA, 335 bp, Homo sapiens
acagcaagactctaatagacacacagacagataaattttaaagtttccattaaaaataagaactattggcagggtgcggtggctcacacctgtaatgccagcactttgggaggccaaggtgggcggatcatgaggtcaggagatcgagaccatcctggctaacacggtgaaaccccatctctactgaaaatacaaaaaaattagccaggcgtggtggtgggtgcctgtagtcccagctactcgggaggctgaggcaggagaatggcgtgaaccctggaggcggagcttgcagtgagccgaggtcgtgccactgtgctccagcctgggcgacagag

SEQ ID NO: 3914 - DNA, 494 bp, Homo sapiens
gactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagggactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaagtgtaagcccatctgctggcaaggctaagattagaacagctcataggagagtcatgattttgaatcacccagataaaggtggatctccttacgtagcagccaaaataaatgaagcaaaagacttgctataaacaaccaccaaacattgatgc

SEQ ID NO: 3915 - DNA, 506 bp, Homo sapiens
ggcacgaggggccgcacctcaggggtgatggagccgcagagctgactgatgagggcgagttggtgctgctccgtgttgccctgcatgatggggctgcgggtccacatctctgccatgatgcacccagcaccccacaggtcaatgggggggccgtagtcccgctccccgagcaacagctccgggggccggtaccagagtgtcaccacacggttggtgtagcggttgggctggctgttcttggccaggctgaaggcccgggccagcccaaagtctgccagcttcaggaccccatcacgagtgataagcacattagcagccttcatgtccctatgcaggatcttgtttctgtggatgtactaaaggccgttaagcagcatctgcatcaccctcttgatctcagacagcgtgaacttgaccaaaacattgctcaacagcccatcaaggtcatgctcgcagaagtcgaacaccaggtatatactacccttgcagaggttatagggggaagc

SEQ ID NO: 3916 - DNA, 609 bp, Homo sapiens
actatagggaatttggccctcgaggccaagaattcggcacgagggacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgc

SEQ ID NO: 3917 - DNA, 553 bp, Homo sapiens
gaatttggccctcgaggccaagaattcggcacgaggtttcctgcgcaggagccgcagggccgtaggcagccatggcgcccagccggaatggcatggtcttgaagccccacttccacaaggactggcagcggcgcgtggccacgtggttcaaccagccggcccggaagatccgcagacgtaaggcccggcaagccaaggcgcgccgcatcgctccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtcta

SEQ ID NO: 3918 - DNA, 480 bp, Homo sapiens
gacagaagggccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgattta

SEQ ID NO: 3919 - DNA, 506 bp, Homo sapiens
gactcggcgggcgctgttgagggagtcgggccgcgactgtggtcgtttttataccttcccgcgcggacgccggcgctgccaacggaagggcggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctg

SEQ ID NO: 3920 - DNA, 499 bp, Homo sapiens
agtttgctcaatttgaaaaggagaaaatgaatgccaaatgggacacgggtgaaaatcctatttataagagtgccgtatcaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttcatcatgtattaaaactgatttttagctttac

SEQ ID NO: 3921 - DNA, 498 bp, Homo sapiens
gcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaatgtaccgaaagcacagtaatcactggtgtcgatattgtcatgaaccatcacctgcaggaaacaagtttcacaaaagaagcctacaagaagtacatcaaggattacatgaaatcaatcagagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactacc

SEQ ID NO: 3922 - DNA, 447 bp, Homo sapiens
cagaagggcaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 3923 - DNA, 522 bp, Homo sapiens
cagaagggggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactacc

SEQ ID NO: 3924 - DNA, 352 bp, Homo sapiens
  misc_feature 40, 51: n = A,T,C or G
aacagagtctctgtctgttgtgcaggctggagtgcaatgncacgatctcanctcactgcaacctccgcctcccaggttcaagcaattctcctgcttcagccttctgagtagctgggattacaggcgcctgccacctcacctggctaatttttgtatttttgtagagaaggggtttcaccatgttggccacgttagttatgaactcctggactcaagcgatctgactgcttcagcctcacaaagggctgggaccacaggcttgagccaccgtgcctggcactactcccacttctataaccccttcatctctctgatccttttatcctcatgacagctttacccaagcccctga

SEQ ID NO: 3925 - DNA, 325 bp, Homo sapiens
ggtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtag

SEQ ID NO: 3926 - DNA, 310 bp, Homo sapiens
gacagaaggggaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgcagagagagtaaaaaatttaacacccatagtaggcctaaaagcagccaccaattaagaaagcgttcaagctcaacacccactaccc

SEQ ID NO: 3927 - DNA, 460 bp, Homo sapiens
gctctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaat

SEQ ID NO: 3928 - DNA, 480 bp, Homo sapiens
gcgcgcagtgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggtgttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttc

SEQ ID NO: 3929 - DNA, 481 bp, Homo sapiens
ggacctcccggctcgacatgcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctgtccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattact

SEQ ID NO: 3930 - DNA, 458 bp, Homo sapiens
gcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattacaagataaaaacatacttttagaagaaaaaagataaatttaaacctgaaaagtaggaagcagaagaaaaaagacaagctaggaaacaaaaagctaagggcaaaatgtacaaacttagaagaaaattggaagatag

SEQ ID NO: 3931 - DNA, 448 bp, Homo sapiens
gacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgatactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaac

SEQ ID NO: 3932 - DNA, 456 bp, Homo sapiens
gggcagagccgcaggtcagtcgtgaagagggagctctattgccaccatgagtttctccggcaagtaccaactgctgagccaggaaaactttgaagccttcatgaaggcaatcggtctgccggaagagctcatccataaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacagctttcaaaaacatcaagtctgtgaccgaactcaacggcgacataatcaccaataccatgacattgggtgacattgtcttcaagagaatcagcaggagaatttaaacaagtctgcatttcatattatttta

SEQ ID NO: 3933 - DNA, 284 bp, Homo sapiens
gctaaacctagccccaaacccactacaccttactaccagacaaccttagccaaaccatttaccctaataaagtataggcgatagaaattgaaacctggcgcaatagatatagtaccgcgcgggaaagatgaaaaattataaccaagcataatatagcgaggactaacccctataccttgtgcataatgaattaactagaaataactttgcaaggagagccaaagctaaacctagccccaaacccactccaccttactaccagacaaccttagccaaaccattta

SEQ ID NO: 3934 - DNA, 369 bp, Homo sapiens
agtgcagtggcatgatctcggctcactgcaagctccgcctcccatgttcaccccattctcctgcctcagcctcctgagtagctgggactacaggcgcccaccaccatgcccggctaattttttttgtatttttagtaagacggggtttcaccatgttagccaggatggtctagatctcctgacctggtgatctgcccccctcggcctcccaaagtgctgggattacaggtgtgagccacctcacctggccaatacaatcactcttaatcccatccctcgtcaatgatcctctttggctgaccccctttgatatttggaggagttgggtctcctctcagtcctctgtatctggcattcacttctagccct

SEQ ID NO: 3935 - DNA, 449 bp, Homo sapiens
atggagtctcactctattgcccaggctggagtgcagtggcacgatcttggctcaccacaacctctgcctcccaggttcaagcaattctcttgcctcagcctcccgagtagctgggactacaggcatgcgccaccatgctgggctaatttttgtatttttagtagagacggggtttcactatcttggacaggctggtctcgaactcctgaccttgtgatccacctgcctcagcctcccaaattactgggattacaggcgtgagccaccgcgctcggcctgacttcaaattttttaagctcactgaaggcataatataaacttgttaacttaattctttatccttaacaatacaagtgaacgggaagatcattatgatacctataataattaaacaatattaaacatgtctcaagtacaataaagttccatttatgaaataactttctggt

SEQ ID NO: 3936 - DNA, 111 bp, Homo sapiens
gacccctctctgtctcactctcctcactctttgcataggttctgtggcttcttctgacctgactcatgaccctgctgtgtctgcggccttcgggacaaacagtcacgatca

SEQ ID NO: 3937 - DNA, 304 bp, Homo sapiens
gggattaaaacactgaactgacaattaacagcccaatatctacaatcaaccaacaagtcattattaccctcactgtcaacccaacacaggcatgctcataaggaagggttaaaaaaagtaaaaggaactcggcaaatcttaccccgcctgtttaccaaaaacataacctgtagcataaaacagtgtgggaggcaccgactgcccagtgacacatgtttaacggccggggtaccctaaccgtgcaaaggtagcataatcacttggtccttaattagggacctgtatgaatggctccacgagggtt

SEQ ID NO: 3938 - DNA, 458 bp, Homo sapiens
gcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttctt

SEQ ID NO: 3939 - DNA, 340 bp, Homo sapiens
taatcccagcactttgggaggccaaggcgggcggatcacgaggtcaggagattgagaccatcctgcctaacacggtgaaaccccgtctctactaaaaaaatacagaacattagcctgacgcggtggcgggtgcctgtagtcccagctactcggggggctgaggcaggagaatggcgtgaacccaggaggaggagcttgcagtgagccgagatagcgccagcgcactccggcctgggcaaaagagtgagactccgtctcaaaaaaacacaaacaagaaaagaagctagttagctctgtcataactgccagtgattcatagacccacatgtttcagagcagg

SEQ ID NO: 3940 - DNA, 414 bp, Homo sapiens
gctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtgcagcccaccgcctgccgacttgtgtcatgccctacgttggtataatcacatcaagtcttacgaaaaggaaaaggccagcctgccaggagtgaagaaagctgtgggcaaatatggtcctgccgatgtggaagacactacaggaagtggagctacagatagtaaagatgatgatgacattgacctccttggatctgatgatgagga

SEQ ID NO: 3941 - DNA, 453 bp, Homo sapiens; identical to SEQ ID NO: 1003

SEQ ID NO: 3942 - DNA, 319 bp, Homo sapiens
tactagatggaaagagatctgtagtgggccacagatcctgataaaggtctcttcatctctctaccccagttgccaccctctgctgtccccgcagagtttgcttggactataaagctgacaggagtgaagtaatcatttgagtgcaagaagaaagaggcgctgctcactgatttcctgcttcagtttttctcttatagtaccatcactataatcaacgaacttctcttctccacccaaagatggcttttccaacacattttaattaaaggaactgagtacattaccctgatgtctaaatggaccaaagatctgagatcca

SEQ ID NO: 3943 - DNA, 502 bp, Homo sapiens
gcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgt

SEQ ID NO: 3944 - DNA, 224 bp, Homo sapiens
gcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgcgtacctttggagataatgataaaattcaacaggttgaacc

SEQ ID NO: 3945 - DNA, 459 bp, Homo sapiens; identical to SEQ ID NO: 1004

SEQ ID NO: 3946 - DNA, 497 bp, Homo sapiens
aggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccaccttcttcagggcgcatgagaccatattaaattctatttactatttgttgaatttatttttccgtcagttatgtaaaataaacatactcttct

SEQ ID NO: 3947 - DNA, 432 bp, Homo sapiens
ataatatagtgcagttcatggaacatagtaacacctcaaatatatttgttgagctaatgaatactaagctctgttcatgcaaactcagcctttgtgcttgattgctcatcttagtatggtcatctgctcacaccttaaaaagtaggctgaggccgggcacagtggcttacacctgtaatcccagcacttcgggaggccgaggtgggtggatcacctgaggtcaggaggtcaagaccagcctggccaacatggcgaaaccctgtctctactgaaatataaaaattagccaggcgtggtggtgggcgcctgtaatcccagctactcagggggctgaggcaggagaatcacttgaacccaggaggcagaagttgcagtgagctgagatcgtgccactgcactccagcctgggtaacaagagtgagactccatctc

SEQ ID NO: 3948 - DNA, 272 bp, Homo sapiens
ggctatcacctccgcctgtggatgctgcgcctctccgaacgcaacatgaatgtgctccttgccgacgacctcatcgcggggtccgtcttcttcctgctgctgccgggaccttctgcggccgatgagaacaagaaggggcccaaagtcacacgtcgaggcgtattatgacctacgaagtggagatgaacatgtaagccggatgatcttaggtctcttcggaaagactgttccaaaaacagtgagataattttgtggccttagctacaggagag

SEQ ID NO: 3949 - DNA, 77 bp, Homo sapiens
tgtgtggtactcattatggtgcagtgcgggcatgaaatgaagacacccaaataggcttacagatacgatatgtttta

SEQ ID NO: 3950 - DNA, 400 bp, Homo sapiens
ataatccggctgtaccagcgtcctggtcccggaactgccaaagccaagaactgaccggggccagggctgccatggtctccttgcctgctccaaggcacaggatacagtgggaatcttgagactctgtggccatttcccatggctcagactaagctccaagcccttcaagagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaacagcctggatttacagaaacatatagatctg

SEQ ID NO: 3951 - DNA, 503 bp, Homo sapiens
cagaagggatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagc

SEQ ID NO: 3952 - DNA, 265 bp, Homo sapiens
attctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagc

SEQ ID NO: 3953 - DNA, 283 bp, Homo sapiens
gatgtataaagggttccaagccttaggggatgccgctgacatccgggtcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttaactcaacgccggggcttcaccaagacctacactgttggctgtgaggaatgcacaatgtttccctgtttatacatcccctgcaaa

SEQ ID NO: 3954 - DNA, 219 bp, Homo sapiens; identical to SEQ ID NO: 1009

SEQ ID NO: 3955 - DNA, 51 bp, Homo sapiens
aggggagtactgcggccgtgtgggtgaattggctgcccgtgagttgggtgc

SEQ ID NO: 3956 - DNA, 94 bp, Homo sapiens
gaaggggactgaagcccgcgctggtctgtggggctctggccgcgcctgggctggccgggaccatgtgcgcgttccgggaccactcgcgctgtgt

SEQ ID NO: 3957 - DNA, 220 bp, Homo sapiens
gaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcac

SEQ ID NO: 3958 - DNA, 74 bp, Homo sapiens
tatcagttttgacactgacaggagtggaacagtagacccacaagaattgcagaaggccctgacaacaatgggat

SEQ ID NO: 3959 - DNA, 407 bp, Homo sapiens
acagaaggggcttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaa

SEQ ID NO: 3960 - DNA, 466 bp, Homo sapiens
gctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgg

SEQ ID NO: 3961 - DNA, 468 bp, Homo sapiens
agggcaatggcatgatctcggctcaccacaacctctacctcccgggttcaagtgattctcttgcctcagcctcccgaacaactgggattacaggcatgcgtcaccacacccggctaattttgtatttttagtagaaatggagtttctccatgttggtcaggctggtctcaaactcccgaactcaggtgatccccctgcctcagcctcccaaagtgctgggattacaggtgtgagccatggcgcccagccccttcggattctttctataagcaaattgtgccttggacataggctttgaatgctttgagagaacctctcttcataagtggaaataaaatcatgatttaattgtatcaaacgcattatggataatctatgggatttaatgaatcaataggtgaggctgagttggtaagaagtgaactttacttctgcatttaaaaaaatacatttaactcaataggaagt

SEQ ID NO: 3962 - DNA, 341 bp, Homo sapiens
gggcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacattt

SEQ ID NO: 3963 - DNA, 336 bp, Homo sapiens
gaagggatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacagggaggagtttgtgcagttgctgacacttcttgttgcacataaataaatacagtgggtactatagagactcagttgcaaaaattaacaaatatgctgcttgattaaaatgggtagg

SEQ ID NO: 3964 - DNA, 366 bp, Homo sapiens
gagaggtaggaaggacagcagagctgacagtcacagcagccctgacaagagagttcctggagcccaagctcttctccacagaggacaagcaggcagcagagaccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtc

SEQ ID NO: 3965 - DNA, 231 bp, Homo sapiens
gcttttcctccttggctgtctgaagatagatcgccatcatgaacgacaccgtgactatccgcactagaaagttctcgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttg

SEQ ID NO: 3966 - DNA, 466 bp, Homo sapiens
gcttttccggttgcggcgccgcgcggtgaggttgtctagtccacgctcggagccatgccgtccaagggcccgctgcagtctgtgcaggtcttcgtacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgccc

SEQ ID NO: 3967 - DNA, 459 bp, Homo sapiens
gagtctgggcctaaggaagcagcactggtggtgcctcagccatggcctggaccgttctcctcctcggcctcctctctcactgcacagggtctgtgacctcctatgcgctggctcaggcgccctcggtgtccgtggccccaggacagacggccacgattacgtgtgggacaaacaacattggagctaagaaagtgcactggtaccaacagaggccaggccaggcccctgtggaggtcgtctatgataatgaccaccggccctcagggatccctgagcgattctctggctccaactttgggaacacggccaccctgaccatcagcagagtcgaagccggggatgagggcgactattactgacacctgtgggatattggtagttctcataaactgttcggcggagggaccaagctgaccgtcctaggtcagcccaaggctgccccctcagtcactctgttcc

SEQ ID NO: 3968 - DNA, 365 bp, Homo sapiens
gcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctaaagttccagcaaaaaagatcaccg

SEQ ID NO: 3969 - DNA, 444 bp, Homo sapiens
aggattttttgtgcttgatacatggtatccagtttgcatagtatcacttctttgtaatccagttgctgctaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgc

SEQ ID NO: 3970 - DNA, 465 bp, Homo sapiens
ggttttgcagacgccaccgccgaggaaaaccgtgtactattagccatggtcaaccccaccgtgttcttcgacattgccgtcgacggcgagcccttgggccgagtgtcctttgagctgtttgcagacaaggtcccaaagacagcaaaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtacatggcatatgctggacccaacacaaatggttcccagtttttcatctgcactgccaagactgattggttgtatggcaagcatgtggtgtttggcaaagtgaaagaaggcatgaatattgtggag

SEQ ID NO: 3971 - DNA, 456 bp, Homo sapiens
gctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggag

SEQ ID NO: 3972 - DNA, 357 bp, Homo sapiens
acagaaggggtagtaatgccagagtaaagccatgacatctagttaacttttaattttagatacacaatgaatgtcttttttcaaaaaagtgtgtatccctgtaatcccagcaatgtgggaggccgagacgggcggatcacgatgtcaggagatccagaccatcctggctaacgcggtgaaaccccgtctctactaaaaaatacaaaaattagctgggcgtggtggcggaagcctgtagtcccagctactcaggaggctgaggcaggagaatggcgtgaacccgggaggcggagcttgcagtgagtggagatcgcgccactgcactccagcctgggcgacagagcgagactgtgtctc

SEQ ID NO: 3973 - DNA, 494 bp, Homo sapiens
atttgtcccacgacgtgctccttttgatctgtttgaaaacagaaagaaaaagaacaatatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcag

SEQ ID NO: 3974 - DNA, 391 bp, Homo sapiens
gggaaccgccattctgtctgttaactatggtcttcaactttaacaaggctaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaacaaagaagatattaagaaaatgataagtgaaattgataaggaagggacaggaaaaatgaactttggtgactttttaactgtgatgacccagaaaatgtctgagaaagatactaaagaagaaatcctgaaagctttcaagctctttgattgatgatgaaactgggaagattt

SEQ ID NO: 3975 - DNA, 439 bp, Homo sapiens
atcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctctt

SEQ ID NO: 3976 - DNA, 432 bp, Homo sapiens
tgtgtacgtatgtgctcagagcaagggactttctgcatgtggagaaaacgccttttgccctaagaagtctacctcaaaccaaagggatgaagtgatgtatctgtgttgcaacactgggcttgggggaaagtgaagctgtgcttgctttaaaagagctgtgctaagtatctgcagaatagctgctccaaaaatggaatctttattccaggtacttggtttctaatatttttttttctcttgcaagtgtaaccttctgagttttctttctccttgtggacttgtttcttagcaacttattcaaacctacagtacttatatgaatttgcagcccaccagttacacacccataattctacagggacttaagatgtttttacaaaacggtgaaactttgtcgtggaggctcttgggggagttcagtgggttaaaagg

SEQ ID NO: 3977 - DNA, 535 bp, Homo sapiens
agcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatg

SEQ ID NO: 3978 - DNA, 465 bp, Homo sapiens
gcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcag

SEQ ID NO: 3979 - DNA, 452 bp, Homo sapiens
gctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgag

SEQ ID NO: 3980 - DNA, 451 bp, Homo sapiens
gacagaaggggctgtttttcaggcggccgggaagatggcggacattcagactgagcgtgcctaccaaaagcagccggccatctttcaaaacaagaagagggtgctgctgggagaaactggctaggagaagctcccgcggtactacaagaacatcggtctgggcttcaagacacccaaggaggctattgagggctcctacattgacaagaaatgccccttcactggtaatgtgtccattcagagggcggatcctctctggcgtggtgaccaatatgaacatgcagaggaccattgtcatccgccgagactatctgcactacatacggaagtacaaccgattcgagaagcgccacaagaacatgtctgtacacctgtcccactgcttcacggacgtgcatatcggcgacatcatgacagagggcgagtgccggcctctgagcaagacagagcg

SEQ ID NO: 3981 - DNA, 131 bp, Homo sapiens
aggggctgcatggcctttgcaagcatgaccgaccatgcacggatagtcatcaacagggcccaaggtggagagccacagccaccggctgactggagatgacccggacactgcggactacataacccgctaca

SEQ ID NO: 3982 - DNA, 453 bp, Homo sapiens
gctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtcctgatcggtgacatcgtcacagtgggcgagtgccggcctctgagcaagacagtgcgcttcaacgtgctc

SEQ ID NO: 3983 - DNA, 492 bp, Homo sapiens
gagggcagcgagaggttcgcgggtgcagcgcacaggagatcatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatact

SEQ ID NO: 3984 - DNA, 305 bp, Homo sapiens
ggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaag

SEQ ID NO: 3985 - DNA, 337 bp, Homo sapiens
ggcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggaaatcctcaatgtcacgctggtgccctacggag

SEQ ID NO: 3986 - DNA, 341 bp, Homo sapiens
cggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaat

SEQ ID NO: 3987 - DNA, 393 bp, Homo sapiens
gctcttcctgctctccatcatggcggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatcta

SEQ ID NO: 3988 - DNA, 424 bp, Homo sapiens
aagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaact

SEQ ID NO: 3989 - DNA, 377 bp, Homo sapiens
gcttttccaagcggctgccgaatatggcggaggtgcaggtcctggtgcttgatggtcgaggccatctcctgggccggctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaatcgaggccaggccgctctggaccgtctcaaggtgtttgacggcatcccaccgccctacgacaagaaaaagcggatg

SEQ ID NO: 3990 - DNA, 437 bp, Homo sapiens
gggattacagctgtgagccaccgtgcctggccttttattgcttgtttttgagacggagtctcactctgttgcccaagctgaagtgcagtggtgtgatcttggctcactgcaacctctgcctcctggggtcaagcgattctcctgcctcagcctcctgagtagctgggcttacaggcacccaccaccatgcccggctaatctttgtatttttagtagagacggggtttcaccatcttggccaggctggtgtgatcatggctcattgcaaccttgaattcctgggcacaagtgatcctcctgccttagcctccccagtatagctgggactacaggtatgcgccaccacacctggctaatttttttaattttaatttttgtagagatgggggggcaggtctcactatgttgcccaggctgttctctaactcctggccaca

SEQ ID NO: 3991 - DNA, 496 bp, Homo sapiens
gctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtact

SEQ ID NO: 3992 - DNA, 361 bp, Homo sapiens
gagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcact

SEQ ID NO: 3993 - DNA, 491 bp, Homo sapiens
aaaccacttcctaattttttcctgtttctgaattgtaaaaccccctttgggagtccctggtttcttattgagccaatttctgggttaatcttattgatttttcagcatcagtacaactctacaacctttgagctatatctgctttttcccattgcttccactgccttttaaaactcaacacagctttttgaataatttgagagtcaaattcaatcacaaatgctgagcagaataagagtgaagtacactatacttaaaatggaaatagattaaaaacaacattactgaaacccttcgcaaggcaaaatgtgtctccttttgataataagctgcatatactatcaggtcctctctttctttatatggtgaacatatatttttaatgaaatgtctctcatttttttaataacagatttattgagatataattcacacaccatgaaattcacccttacaaaacgtacaattcagtggtcttcagtatgcttaca

SEQ ID NO: 3994 - DNA, 280 bp, Homo sapiens
ctttgcaaggagagccaaagctaagacccccgaaaccagacgagctacctaagaacagctaaaagagcacacccgtctatgtggcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaagaaaaaaccttgcagagagagtaaaa

SEQ ID NO: 3995 - DNA, 385 bp, Homo sapiens
agtgagacttgatctcaaaaaagagaagggagagagagggagagagggagaggaaagaaaggaagaaaagaaaagaaaaatgcaaagagaggccaggcgcagtggctcttgcctgtaatcccagtactcactctgttgcccaggctggagtgcaatggcgtgatcttggctcgctgcaacccccgcctcccgggttcaaaggattctcctgcctcagcctcccgagtagctgggactacaggcgcctgccaccacgcccagctaatttttatacttttaatagagacggggtttcaccatgttggccaggatggtctcgatctcttgaccttgtgatccgcctgccttggcctcccaaagtgctgggattacaggcatgagtcac

SEQ ID NO: 3996 - DNA, 336 bp, Homo sapiens
aaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaagaaaaaaccttgcagat

SEQ ID NO: 3997 - DNA, 445 bp, Homo sapiens
caggcattctagctgggaaccgttcttcctcccctcaccagaaccttcagactaaaccaggcatcaagattttccgctttgtagcccctctctactacataaacaaagaatgcttgtgttctgctttatacaaacaaactgtcaacccaatcttaataaaggtggcttggaagaaggcagcaaagagaaagatcaaagaaaaagtagtgactcttggtggaatccaggatgaaatgtcagtgcaactttcccatgatcccttggagctgcatactatagtgattgactgcagtgcaattcaatttttagatacagcagggatccacacactgaaagaagttcgcagagattatgaagccattggaatccaggttctgctggctcagtgcaatcccactgtgagggattccctaaccaacggagaatattgcaaaaaggaagaaga

SEQ ID NO: 3998 - DNA, 319 bp, Homo sapiens
cttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaag

SEQ ID NO: 3999 - DNA, 174 bp, Homo sapiens; identical to SEQ ID NO: 1022

SEQ ID NO: 4000 - DNA, 330 bp, Homo sapiens
gccctcactcgccgccgacgacctgtctcgccgagcgcacgccttgctgccgccccgcagaaatgcttcggttacccacagtctttcgccagatgagaccggtgtccagggtactggctcctcatctcacccgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaat

SEQ ID NO: 4001 - DNA, 327 bp, Homo sapiens
gaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgttt

SEQ ID NO: 4002 - DNA, 279 bp, Homo sapiens
ctgcccttcacctcgcagtggacctgcaaaatcctgacctggtgtcactcctgttgaagtgtggggcgtgtgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggag

SEQ ID NO: 4003 - DNA, 292 bp, Homo sapiens
caaccaccatgtctggctggtaaccgccatgatacatcaccgaccagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttg

SEQ ID NO: 4004 - DNA, 408 bp, Homo sapiens
caagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgg

SEQ ID NO: 4005 - DNA, 402 bp, Homo sapiens
aaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttc

SEQ ID NO: 4006 - DNA, 371 bp, Homo sapiens
agtctgggcctaaggaagcagcactggtggtgcctcagccatggcctggacctttctcctcctcggcctcctctctcactgcacaggctctgtgacctccgatgtgctgactcagccaccctcagtgtcagtggccccaggacagacggccaggattacctgtgggggagacaacattggaagtaaaagtgtgcactggtaccagcagaagccaggccaggcccctgtgctggtcatctattatgatagcgaccggccctcagggatccctgagcgattctctggctccaactctgggaacacggccaccctgaccctcagcagggtcgaagccgaggatgaggccgactattactgtcaggtgtgggatg

SEQ ID NO: 4007 - DNA, 395 bp, Homo sapiens
gcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccg

SEQ ID NO: 4008 - DNA, 336 bp, Homo sapiens
aaaatatatatatatacacacacacatatacatacaaagtcaaactgaagaccaaatcttagcaggtaaaagcaatattcttatacatttcataataaaatgagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaatttttttttctcactctaaaagagggggggctca

SEQ ID NO: 4009 - DNA, 335 bp, Homo sapiens
tgtcacccaggctggagtgcagtggtgtgatatctcggctcactgcaacctccacctcctgggttcaagcgatcctcccacctcagcttcccgagtagctgggattatgggagcaagccaccacacccggctaatttttgtatttttaatagagacggggtttcaccatgttgaccaggctggtctcgaactcctgaccttatgcgattcgcctgccttagccttccaaagggctgcgattacaggcgtcaaccaccacgcccagcctagatatttggtttatcttagaaggaggccacaagagagctacaatcacatttttcggaaaaaatacg

SEQ ID NO: 4010 - DNA, 178 bp, Homo sapiens
aacttgaccaacggaacaagttaccctacggataacagcgcaatcctattctagagtccatatcaacaatagggtttacgacctcgatgttggatcacgacatcccgatggtgcaagcactattaaaggttcgtttgatcaacgattaaagtcctacgtgatctgagttcagaccgga

SEQ ID NO: 4011 - DNA, 429 bp, Homo sapiens
ggcaagtggatgataaacctgatgtcacatacagtgatgttggtggctgtaaggaacagattgggaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgagaactctttgaaatggccagaacaaaaaaagcctgccttatcttctttgatgaaattgatgctattggaggggctcgttttgatgatggtgctggaggtgacaatgaagtgcagagaacaatgttggaactgatcaatcatcttg

SEQ ID NO: 4012 - DNA, 301 bp, Homo sapiens
cacatgccatgtacagcatgaggggctgccgaagcccctcaccctgagatgggagccgtcttcccagtccaccgtccccatcgtgggcattgttgctggcctggctgttctatcatttgtggtcatcggagctgtggtcgctgctgtgatgtgtaggaggaagagctcagttggaaaaggagggagctactctcaagctgcgtgcatcgacagtgcccagggctctgatgtgtctctcacagcttgaaaagcctgagacagctgtcttgtgagggactgagatgcatgatttcttcacgcc

SEQ ID NO: 4013 - DNA, 367 bp, Homo sapiens
ggactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaag

SEQ ID NO: 4014 - DNA, 653 bp, Homo sapiens
tgagtagatgatcttgtcgctgtcggggttcaggtccacgaacatcttcaggatgaactcccgcgccgcctgggcgtcccgctggggaccatcgaactcggggaagtagtccaccaggtgcgagtacaggatcttgtcctccagcaggtccttcttgttgaggaagaggatgacggaggagttctggaaccaggggtaggtgatgatggtccggaacagggctttgctctcctccatccggttctcgttgtccgactccaccaggacttggtcgtattcgctgagggcgacgagaaacatgatggatgtcacgttctcaaagcagtggatccacttcctccgctccgaccgctggccccccacatccaccatccggaagatgatgttctccaggtgaaaaggggtactcgatgatgccggtggtgggcacgcggacccgcagcacgtcctgctgggtgggcaggtagcccaaggtggcgatgcggtcaacgtcggtcaggtagtacttggcagagtcggagagctggtactcgcgcctgcggtcgtagcattcctggatgcccgggtcctcccacagggtcttgatggcactgacgtactgatgctcgaaggtggtcaccttctccacgtccacctcccggatcaggagcgca

SEQ ID NO: 4015 - DNA, 497 bp, Homo sapiens
gtctgcccggctgcagggatggcggggaggggtaagctcatcgcagtgatcggagacgagtacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccatt

SEQ ID NO: 4016 - DNA, 232 bp, Homo sapiens
gggttatagactgcatctttattattattattattatttttaattttttgaggtagagtcaagctctgtcgcccaggctggagtgcagtggcacgatcttggctcactgcaacctccacttcccaggtttgagcaattctcctgcctcagcctcctgagtagttgtaactataggcgtgcgccaccacgtcttgctaatttttgtatttttagtagagacagggttttacct

SEQ ID NO: 4017 - DNA, 475 bp, Homo sapiens
agtatgagttggggcgcccagctgccatcaccaagattggcccccgacgcatccacacagtccgtgtgcggggaggtaacaagaaataccgtgccctgcagttggacgtggggaatttctcctgaggctcagagtgttgtactcgtaaaacaatgatcatcgatgttgtccacaatgcatctaataacgagctggttcttaccaagaccctggtgaagaattgcatcgtgctcatcgacagcacaccgtaccgacagtggtacaagtcccactatgcgctgcccctgggcctcatgaagggagccaagctgactcctgaggaataagacattttaatcaaaaaacgatctaaaaaaattcagaagaattatgatgaaaggaaaaagactgccaaaatcagcagtctcctggaggagcagttccagcatggcaagcttcttgcgtgcatcgcttcaaggccgggacagtgtggccg

SEQ ID NO: 4018 - DNA, 533 bp, Homo sapiens
ggaaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataa

SEQ ID NO: 4019 - DNA, 523 bp, Homo sapiens
gctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggag

SEQ ID NO: 4020 - DNA, 433 bp, Homo sapiens
acgacagaaggggagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggctaggcatgttggtttgcgtgtgggaatcccaaaggagaccccagctctcacgattaataggctctgtggttctggttttcagtccattgtgaatggatgtcaggaaattttgtgttaaagaagctgaagttgttttatgtggaggaaccgaaagcatgagccaagctccctactgtgtc

SEQ ID NO: 4021 - DNA, 456 bp, Homo sapiens
caggcatgctcataaggaaaggttaaaaaaagtaaaaggaactcggcaaatcttaccccgcctgtttaccaaaaacatcacctctagcatcaccagtattagaggcaccgcctgcccagtgacacatgtttgacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactata

SEQ ID NO: 4022 - DNA, 398 bp, Homo sapiens
ggtcagtcgtgaagagggagctctattgccaccatgagtttctccggcaagtaccaactgcagagccaggaaaactttgaagccttcatgaaggcaatcggtctgccggaagagctcatccataaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacagctttcaaaaacatcaagtctgtgaccgaactcaacggcgacataatcaccaataccatgacattgggtgacattgtcttcaagag

SEQ ID NO: 4023 - DNA, 317 bp, Homo sapiens
taaagagggagctctattgccaccatgagtttctccggcaagtaccaactgctgagccaggaaaactttgaagcctgcgtgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacatgggagaaagtcaagacagtggttcagttggaaggtgacaataaactggtgacagctttcaaaaacat

SEQ ID NO: 4024 - DNA, 440 bp, Homo sapiens
agccaccagaacacagaatgttcttggtgagaagggccggcggattcgggaactgactgctgtagttcaaaagaggtttggctttccagagggcagtgtacagctttatgctgaaaaggtggccactagaggtctgtgtgccattgcccaggcagagtctctgcgttacaaactcctaggagggcttgctgtgcggagggcctgctatggtgtgctgcggttcatcatggagagtgggtccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaaga

SEQ ID NO: 4025 - DNA, 478 bp, Homo sapiens
ggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactg

SEQ ID NO: 4026 - DNA, 417 bp, Homo sapiens
atgggattgtgcagcttgaggtagtatggcacagtggttacaaacagatgctagatctggcttcacatctcatctctgccacttactggctgtctgactttattattattattattattttttgagatagtgtctcgctttggtgcccaggctggagtgcagtggcctgatctcggctcactacaacctctgcctcccgggttcaagcaattctcccacctcagcctcccaagtagctgggattacagacatgtgccaacacgccgagctaatttttgtatttttaatagagacagtgtttcaccatgttggccaggctggtctccaactcccgaccttaggtgatccaccttggcctcccaatgtgctgggattacaggaagtgctgggattacaggcatgaaccaccgacctgac

SEQ ID NO: 4027 - DNA, 109 bp, Homo sapiens
ataaaaaataaaaacctaaaaaaaaaaattttaaaaaaaaaaaaaaaaaaaaaaaagggggggggttttttttttttccccccccaaaaaaaaaaacccgggggggggg

SEQ ID NO: 4028 - DNA, 391 bp, Homo sapiens
actgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggct

SEQ ID NO: 4029 - DNA, 373 bp, Homo sapiens
gagacgaaagcaactgaagtgggcccaatggcagccatgatgggcagaggcacacacatcgctccgctctgtccactcaaaaaagcagcaaaggctgggcgcggtggcacgcgcctataatcccagcactttgggaggccaaggcgggcggatcatgaggtcaggagatcgagaccatcctggctaacacggtgaaaccccatctctactaaaaatacaaaaaattagccgggcgcggtggctggcgcctgtagtcccagctactcgggaggctgaggcatgagaatggcgtgaacccaggaggcggagcctgcagtgagccaagatcgtgccactgcactccggcctgggcgaaagagcaagactctgtctc

SEQ ID NO: 4030 - DNA, 384 bp, Homo sapiens
cgcctcacctgcttgaacttttcacaactccccctggccttctaccacagtgcccagacttgactgcagcttggatccacctggggagcatactgaaagtaaagattctggctgggcacggtggctaacgcctgtaatcccagaactttgggaggctggggtgggtggatctctatgtcaggagttcaagaccagcctggccaacatggagaaaccctgtctcaaaccgcaaaaattagctgggtgcggaggcagtcacctgtaatcccagctacttgggaggctgaggcaggagaatctcttgaatcttggtggcagaggttgcagtgagccgagatcgcgccactgcactccagcctgggcgacagagggagactctgtctc

SEQ ID NO: 4031 - DNA, 441 bp, Homo sapiens
aggggccaccgtgcccaacctgacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtccaaagaagacattttctcttagagattatcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatctt

SEQ ID NO: 4032 - DNA, 221 bp, Homo sapiens
tccctgcttaccaggagttcacaatatggaggggaagtaaaatcctcagagaaagtcttgctatcataaagctatgaaagatatatgaggccgggcatggtggctcacgtatgtaatcccagcactttgggagaccaaggtggacagatcacgaggtcaagagattgagatcatcctggccaacatgatgaaaccttgtctctactaaaaatacataaatt

SEQ ID NO: 4033 - DNA, 508 bp, Homo sapiens
gcttcgctcttgcctacttcccctacttcatcacctacaagtgcagcggcctgtccgagtacaacgccttctggaaatgcgtccaggctggagtcacctacctctgtgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtcta

SEQ ID NO: 4034 - DNA, 518 bp, Homo sapiens
catgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattgtgctg

SEQ ID NO: 4035 - DNA, 505 bp, Homo sapiens
cagaagggtacagatgtgagccaccgtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtagtcccagcaatttgggaggctg

SEQ ID NO: 4036 - DNA, 452 bp, Homo sapiens; identical to SEQ ID NO: 1032

SEQ ID NO: 4037 - DNA, 377 bp, Homo sapiens
cagaaggggggctctgtcggccaggccacagtgcagtggcaagatcttggctcactacaacctctgcctcctagttcaagcgattctcctgcctcagcctcccaagtagctaggactacaggcgtggaccaccacgcccagctactttttgtatttttagtagagatgaggtttcaccatgttgagcaggctggtctcgaactgctgacctcaggtgatccacctgcctcggcctcccaaagtgctgggattacaggcatgagccactgtgcccagccagtgttgtcaagttttattaggtatttttgttaattccatatcttaagtttactgaaaacactggaatgcctatagcaaaacctggacaagaataaacc

SEQ ID NO: 4038 - DNA, 440 bp, Homo sapiens
gacagaagggcaccaaccagggcagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagggtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaa

SEQ ID NO: 4039 - DNA, 244 bp, Homo sapiens
agacgacacagggggtggcggacaccacccattctagcgtctgccctatcaactttcgatggtagtcgccgtgcctaccatggtgaccacggctgacggggaatcacggttctattccggagagggagcctgataaacggctaccacattcaaggaaggcatcaagctcgcaaattacccactcccgacccggtgaggtagtgacgacccaaagaggtagtgacgaaaaaaaaaaagaaataac

SEQ ID NO: 4040 - DNA, 534 bp, Homo sapiens
ggggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtggggttttctaaactaccg

SEQ ID NO: 4041 - DNA, 507 bp, Homo sapiens
ggcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggcc

SEQ ID NO: 4042 - DNA, 500 bp, Homo sapiens
acagaaggggctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggaatgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcac

SEQ ID NO: 4043 - DNA, 502 bp, Homo sapiens
aagggggaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgctt

SEQ ID NO: 4044 - DNA, 453 bp, Homo sapiens
aggccgaggtgggcggctcacaaggtcaggagtttgacacccgcctgtccaacatggtgaatccctgtctgtactaaaaatacaaaaattagtcgggcatggtggcacacacctgtaatcccagctactcaggaggctgaagcaggagaatagcttgaacctgggaggcagaggttgcagtgagccaagatcatgccactgcactccagcctgggcaacagagcaagattccatctcaaaaaaatataaaattgtacacaaaattgtgtgtatgtatgcattttatttggagacaagggatatcactccctctccccaacactggctaaaaagttactgcaatctggctgggcgcagtggctcacgcctataatcccaacactttggaaggccaaggcgggcggatcacgaggtcaggagattgagaccatcctggctaacacggagaaaccc

SEQ ID NO: 4045 - DNA, 489 bp, Homo sapiens
aattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagcgaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagt

SEQ ID NO: 4046 - DNA, 392 bp, Homo sapiens
ggaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactg

SEQ ID NO: 4047 - DNA, 466 bp, Homo sapiens
ccttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaataca

SEQ ID NO: 4048 - DNA, 449 bp, Homo sapiens
gctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatct

SEQ ID NO: 4049 - DNA, 458 bp, Homo sapiens
ggggcctttcttccttttggtgcgagcttgctgtggtttttgctctgggtcctctgggatggcgcctggctgtggccgcgtggtctctcacgcaggggcgccgagcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagt

SEQ ID NO: 4050 - DNA, 459 bp, Homo sapiens
ggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggc

SEQ ID NO: 4051 - DNA, 295 bp, Homo sapiens; identical to SEQ ID NO: 1034
  misc_feature 170: n = A,T,C or G

SEQ ID NO: 4052 - DNA, 212 bp, Homo sapiens
gaaggggctttcttttctcgttccccggccatcttagcggctgctgttggttgggggccgtcccgctcctaaggcacgaagatggtggccgcgaagaagactaaaaggtggcgtggagtccatcaactctaggctccaactcgttatgaaaagtgggaagtacgttctggggtacaagcagactctgaagatgatcacacacggcaaagcga

SEQ ID NO: 4053 - DNA, 337 bp, Homo sapiens
gggagagcgaaggggagaggatggtactgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggactattcgaggattttgaaacacttgatggaaaaggcatcaagaatgttaaagttttggattccacgtcctttttgggtccttgctgccaaagtgct

SEQ ID NO: 4054 - DNA, 457 bp, Homo sapiens
gcttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctgacagcattgcatgattc

SEQ ID NO: 4055 - DNA, 399 bp, Homo sapiens
gaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaat

SEQ ID NO: 4056 - DNA, 341 bp, Homo sapiens
cggcattctgtctgggaacccctattctatctggaaaccaatgactgtgctgaccagcaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttctt

SEQ ID NO: 4057 - DNA, 371 bp, Homo sapiens
gtatatacattttttttctttaaaaaacaactatggatcagaatagccacatttggaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcttttttttccatctttagaaaactacatgggaacaaacagatcgaacagttttgaagctactgtgtgtgtgaatgaacactcttttgctttatt

SEQ ID NO: 4058 - DNA, 648 bp, Homo sapiens
ttcggcacgaggcgccaagttcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggct

SEQ ID NO: 4059 - DNA, 618 bp, Homo sapiens
gactggatccagtggaatacacgcggttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagt

SEQ ID NO: 4060 - DNA, 148 bp, Homo sapiens
ccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggct

SEQ ID NO: 4061 - DNA, 109 bp, Homo sapiens
attattttattttttacataaggtcacttaaatgaaaagcgattaaaagacttctttcctgcattgccatctacataatatcagatattacggatgttagattgcatct

SEQ ID NO: 4062 - DNA, 622 bp, Homo sapiens
ccaagaattcggcacgaggtacattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttggaaaggataagaaagatcgagacagcagcgtaaggaatattgcttctgaattaacaataattaaagagcagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggagaatatttatacagctgtgcttagctctgcgatacttacacaaggagaagatgattgtccatagagatctgacaccaaacaacattatgttgggggataaggacaaa

SEQ ID NO: 4063 - DNA, 455 bp, Homo sapiens
ggggaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgacc

SEQ ID NO: 4064 - DNA, 433 bp, Homo sapiens
gcctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgc

SEQ ID NO: 4065 - DNA, 309 bp, Homo sapiens
acagaaggggctttttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagagggctccgggttgacaaatggtggggtaacagaaaggaactggctaccgttcggactatttgtagtcatgtacagaacatgatcaagggtgttacactgggcttccgttac

SEQ ID NO: 4066 - DNA, 347 bp, Homo sapiens; identical to SEQ ID NO: 1039

SEQ ID NO: 4067 - DNA, 470 bp, Homo sapiens
aagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatctta

SEQ ID NO: 4068 - DNA, 370 bp, Homo sapiens
gagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaatcctgtaaactggtaccagcaactcccaggaacggcccccaaaatcctcatctatactaatactcagcggccctcaagcgtccctgaccgattctctggctccaagtctggcacctcagcctccctggccatcagtgggctccagtctgaagatgagggtgattattact

SEQ ID NO: 4069 - DNA, 239 bp, Homo sapiens
agctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttggggggaggaaaaaccaaccccctgcccccaaaaaaattaaaaagg

SEQ ID NO: 4070 - DNA, 412 bp, Homo sapiens
gaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagatagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactt

SEQ ID NO: 4071 - DNA, 470 bp, Homo sapiens
ggggctttccggacttggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgcggcactgtcctgctctccggtcctcgcaagg

SEQ ID NO: 4072 - DNA, 476 bp, Homo sapiens
ggtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacataaggagagccatgcgtactttctaaaaactgatggtgaaaagctcttacc

SEQ ID NO: 4073 - DNA, 313 bp, Homo sapiens
gatgatggccacagatgaacaatatgaacattggggccaggcgcggtggctcaggcctgtaatcccagcactttgggaggccgaggtgggtggatcatgaggtcaagagatggataccatcctgggcaacatggtgaaattctgtctctactaaaaatacaaaaattagctgggtgtggttgcacacgcctgtaatcccagctgctcaggaggctgaggcaggagaatcgcttgaacccaggaggcagaggttgcagtgagccgagatcatgccactgcactccagcctgggtgacagagcgaggctccatct

SEQ ID NO: 4074 - DNA, 476 bp, Homo sapiens
ctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctac

SEQ ID NO: 4075 - DNA, 358 bp, Homo sapiens
cggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcagtgcatggcgattccaggcgctgaacaactcccctggacccttgggcctgcatctgactcccagctgcagagtcagaagctgagtccaggcaactgcttggtcactcccgatcgctcctccctggacacccggttaccaaagtcagcaaagaagatgcggtaatcgccgcctgatctccacatggtgaacacaacactcccaccaacac

SEQ ID NO: 4076 - DNA, 171 bp, Homo sapiens
gttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtg

SEQ ID NO: 4077 - DNA, 318 bp, Homo sapiens
actaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgcagagagagtaaaaaatttaacacccatagtaaacctaccgagcctggtgatagctggttgtccaagatagaatcttagttcaactttaaatttgcccacagaaccctctaaatccccttgtaaatttaactgttagtccaaagaggaacagctctttggacactagg

SEQ ID NO: 4078 - DNA, 486 bp, Homo sapiens
ggacgctggagcagaagaataaagaaatagaagaactcaccaagatttgtgacgaactgattgccaaaatggggaaaagctaactctgaaccgaatgttttggacttaactgttgagtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctg

SEQ ID NO: 4079 - DNA, 327 bp, Homo sapiens
aagggggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgcagagagagtaaaaaatttaacacccatagtaaacctaccgagcctggtgatagctggttgtccaagatagaatcttagttcaactttaaatttgcccacagaaccctctaaatccccttgtaaatttaactgttagtccaaagaggaacagctctttggacactagg

SEQ ID NO: 4080 - DNA, 437 bp, Homo sapiens; identical to SEQ ID NO: 1041

SEQ ID NO: 4081 - DNA, 346 bp, Homo sapiens
gagaggatcgacatgactgactaccacgttttcgtcaaggatgcgtcgcagcatgtggattgcatgcagacagactaccctgggcttcctgtcttccttctgggccactccatgggaggcgccatcgtcatcctcacggtcgcagataggcctgtccacttctccgacatggtactcattccgcctctggttcttgccaatcctgaatctgcaacaactttcaaggtccttgctgcgaaagtgctcaaccttgtgctaccaaacttgtccctcgcgcccatacgactacagcgtgctctctcggaataagacagaggtcgacatttataactcagaccccctgatc

SEQ ID NO: 4082 - DNA, 342 bp, Homo sapiens
  misc_feature 342: n = A,T,C or G
ggcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcacccgn

SEQ ID NO: 4083 - DNA, 441 bp, Homo sapiens
actacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatccgcgatggtttattaagaacaaaatgaaggcattttatgctc

SEQ ID NO: 4084 - DNA, 537 bp, Homo sapiens
gggcacgtggagccacggcgtgggagtagggggctgaaggcaggcagcagcggccagggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctaccaagcgacccactga

SEQ ID NO: 4085 - DNA, 536 bp, Homo sapiens; identical to SEQ ID NO: 1043

SEQ ID NO: 4086 - DNA, 404 bp, Homo sapiens
ggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctg

SEQ ID NO: 4087 - DNA, 443 bp, Homo sapiens
ggatatgtgcccttctaaagagcatttatattcaaattccttgaaaagattgctgatcagttaaaacacatttggggtgggtgcagtggctcacacctctaatcccagcactttgggaggccgaggcaggtggattatttgaggtaaggagttcaagaccagcctgaccaacatggtgaaatcctgtctctactaaaaatacaaaaattagcccagcgtggtggtgcatgcctgtaatcccaactacttgggaggctgagacaggagaatcacttgaacctgggaggcagaggttgcagtgagccgagatcgcgccattgcactccagcctggatgacaagagcaaaactctgtctcaaaaaataaaaggccgggcacggtggctcacgcctgtaatcccagcactttgggaggccaaggcgggcggatcacgaggtcaagag

SEQ ID NO: 4088 - DNA, 420 bp, Homo sapiens
ggaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatg

SEQ ID NO: 4089 - DNA, 327 bp, Homo sapiens
aaggggctttctttccccgccgatagcgctcacgcaagcatggttaacgtccctaaaacccgccggactttctgtaagaagtgtggcaagcaccaaccccatagagggacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagat

SEQ ID NO: 4090 - DNA, 415 bp, Homo sapiens
agaaggggaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaact

SEQ ID NO: 4091 - DNA, 443 bp, Homo sapiens
cagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgt

SEQ ID NO: 4092 - DNA, 319 bp, Homo sapiens
catgtaatcccagcactttgggaggctgaggtgggcagatcacgaggtcaggagttcaagaccagcctgaccaacatggtgaaaccctgtctctactaaaaatacaaaaattagccgagcatggtggcacatgcctgtaatcccagctacacaagaggctgaggcagaagaatcgcttgaacccgggaggcagaagttgcagtgagccaagatcgcgccactgcactccagcctgggtgacagagtaagactctgtctcaaaaaaaaggaaaaaaaaaaggaattttgactgggcacagtggctcccacctgtaattat

SEQ ID NO: 4093 - DNA, 353 bp, Homo sapiens
gaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggaga

SEQ ID NO: 4094 - DNA, 519 bp, Homo sapiens
cagaagggctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttcgacactggta

SEQ ID NO: 4095 - DNA, 610 bp, Homo sapiens
aaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctggtgagcctgcaggaagccctgatgtgcagatgagaggcctggggggtggcagaaacaaacagcattacagttcccacccgtcagcacacctctctgagcgtgcaggttcccggacagatcgggaaaccccaccagtaatgattagtttacacatacacatcgcttttgaaggcccccaaacaccaggggaccatagagatcctttggacttcatgattctgggagtgtttgtttgcactgatacctgaagaaatagatcttgagggcctacattccaacctctgggctgaagtaccaacctcggggagaaggaaacaaagatcacaataaagaatcttgtccccaacagattctgggtataaccaaccctgagggtgagaagaagtacctggcggccgcaagcttattccctttagtga

SEQ ID NO: 4096 - DNA, 512 bp, Homo sapiens
tggactgtgcattctccaagaagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgagatctctgtccttgtttctgagactttctctaccattaagctctattttagctttcagttattctagt

SEQ ID NO: 4097 - DNA, 595 bp, Homo sapiens
ctagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatggtggttttcatatcaaaagatcatgttgggattaacttgcctttttccccaaaaaataaactctcaggcaagcatttctttaaagcta

SEQ ID NO: 4098 - DNA, 572 bp, Homo sapiens
  misc_feature 416: n = A,T,C or G
tcactatagggcgaattgggtaccgggcccccccctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatcntacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataac

SEQ ID NO: 4099 - DNA, 489 bp, Homo sapiens
gctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcac

SEQ ID NO: 4100 - DNA, 300 bp, Homo sapiens
gctttccggacctggccgagcaggaggcgccatcatgggagtggacatccgccataacaaggaccgaaaggttcggcgcaaggagcccaagagccaggatatctacctgaggctgttggtcaagtatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgat

SEQ ID NO: 4101 - DNA, 420 bp, Homo sapiens
gcttttccggctgcggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagct

SEQ ID NO: 4102 - DNA, 327 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttt

SEQ ID NO: 4103 - DNA, 342 bp, Homo sapiens
gtcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagccta

SEQ ID NO: 4104 - DNA, 476 bp, Homo sapiens
gcttttttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatttaaaaaacaaaa

SEQ ID NO: 4105 - DNA, 333 bp, Homo sapiens
gcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatg

SEQ ID NO: 4106 - DNA, 394 bp, Homo sapiens
attctgctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgact

SEQ ID NO: 4107 - DNA, 477 bp, Homo sapiens
acagaagggggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactga

SEQ ID NO: 4108 - DNA, 385 bp, Homo sapiens
cagaaggggggcaacatgaaggaggtgttcacccgcttctgcaccggcctcacccagattgaagctctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaagcggtgtggacacggctgcggtgggcggagtcttctacgtctccaacgctgaccgactgggcttctcataggtggagctggtgcagatggtggtggacggagtgaatctgctcatcgagatggaacagcggctggagc

SEQ ID NO: 4109 - DNA, 416 bp, Homo sapiens
tacgggaaggcgaagaaaagaatagagaagatagggaaattagaagataaaaacatacttttagaggaaaaaagatctatttaaacctgaaaagtaggaagcaggggaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgta

SEQ ID NO: 4110 - DNA, 436 bp, Homo sapiens
gaagacgacataaggggcctagggtccttcattgtaatttgctctattcttgggacacaagcatggatcaccagtacaattgctgttagagactctgcttcaaatgggagcattttcatcacttacggactttttcgtggggagagtactgaagaattgagtcacggacttgcagaaccaaagaaaaagtttgcagttttagagatactgaataattcttcccaaaaaactctgcattcggtgactatcctgttcctggtcctgagtttgatcacgtcgctgctgagctctgggtttaccttctacaacagcatcagcaacccttaccagacattcctggggccgacagaggtgtacacctggaacgggctcggtgcatccttactttctgtgaccatgatactgtttgtggcgaacacgcagtccaaccaactct

SEQ ID NO: 4111 - DNA, 278 bp, Homo sapiens
ggagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctccc

SEQ ID NO: 4112 - DNA, 502 bp, Homo sapiens; identical to SEQ ID NO: 2776

SEQ ID NO: 4113 - DNA, 269 bp, Homo sapiens
tcatatgcattgatcaatttctcactgttccatgcatcacttgcaaaatctccaggatggcgtcctgcattcaaatactacaacatgtggatatcacttcttggagcaattctttgttgcatagcaatgtacgtcattaactggagggctgcattgctaacatatgtgatagcccttgggctgtatatttatgttacctacaaaaaaccacatgtgaattggggatcctctacacaaaccctgacttacctgaatgccctgcagcattc

SEQ ID NO: 4114 - DNA, 453 bp, Homo sapiens; identical to SEQ ID NO: 2806

SEQ ID NO: 4115 - DNA, 389 bp, Homo sapiens
gctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgcgcttgcatcctactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaa

SEQ ID NO: 4116 - DNA, 186 bp, Homo sapiens
attataggtgtcagccactgtgcctggctcgatttacctttacctgtttaaatggttggggaaaaaaaaatcgaagctcgagcatcgtggctcatacctgtaatcccagcactttgggaggccaaggcggccggatcacctcacgtcaggattttgaaaccagcctggccaacatggtgaaacccc

SEQ ID NO: 4117 - DNA, 310 bp, Homo sapiens; identical to SEQ ID NO: 1059

SEQ ID NO: 4118 - DNA, 431 bp, Homo sapiens
agggaaataaaataaaaagctggaggacacacttttctctatgtatgctgtacttcaactttttaaaaagtgaataacactaaaagatgttgaatgaataacttcccaaccactagtgggtataaaagggcaataagaataacagtacaggccgggcgcggtggctcacgcgtgtaatcccagcactttgggaggccgtggcgggcggatcacaagctcaggagatcaagaccatcctggctaacacggtgaaaccccgtgtctactaaaaatacaaaaaaattagccgggcatggtggcgggtgcctgtagtcccagctactcgggaggctgaggcaggagaatggcatgaacctgggaggcggagcttgcagtgagccgagattgcacaactgcactccagcctgggccaaagagcaagactccgtctt

SEQ ID NO: 4119 - DNA, 391 bp, Homo sapiens
gagctgtgtcactgggcctggtgctgctggtggtgctgctgctgcttctgaggcactggggctggggcctgtgccttatcggctggaacgagttcatcctgcagcccatccacaacctgctcatgggtgacaccaatgagcagcgcatcctgaaccatgtgctgcagcatgcagagcccgggaacgcacagagcgtgctggaggccattgacacctactgcgagcagaaggagtgggccatgaacgtgggcgacaagaaaggcaagatcgtggacgccgtgattcatgagcaccagccctccgtgctgctggagctgggggcctactgtggctactcagctgtgcgcatggcccgactgctgtcaccaggggcgaggctcatcaccatcga

SEQ ID NO: 4120 - DNA, 521 bp, Homo sapiens; identical to SEQ ID NO: 1060

SEQ ID NO: 4121 - DNA, 258 bp, Homo sapiens
gcttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccactttcgggcccccagccgca

SEQ ID NO: 4122 - DNA, 456 bp, Homo sapiens
gactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactc

SEQ ID NO: 4123 - DNA, 386 bp, Homo sapiens
cagaaggggcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacat

SEQ ID NO: 4124 - DNA, 229 bp, Homo sapiens
cagtctgctgatgttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagttggcacagacccgggcagagggacagcgccaggccc

SEQ ID NO: 4125 - DNA, 381 bp, Homo sapiens
gagtggaggccgcgggctctgagcggcccctgcccggatggcaacagtagttctaggaggagacaccatgggccctgagcttatcttccccaatcagactgagggactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccactgggggatggagatgtagttgctgacatccaggatcgaatccaggccctggggcttcatttgccagacccaccattagagagtgaagatgaagatgaggagggagctccagcgttgaacaacca

SEQ ID NO: 4126 - DNA, 467 bp, Homo sapiens; identical to SEQ ID NO: 2913

SEQ ID NO: 4127 - DNA, 440 bp, Homo sapiens
gaaggggaccccttcgctcacctgcccaagagtacctttgtgttggatgaatttaagcgcaagtactccaatgaggacacactctctgtggcactgccatatttctgggggggggttgataaggacggctggtccctgtggtactcagagtatcccttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccatattggcaggtggactacgagtcatacacatggctgaaactggatcctggcagcgaggatacccacacgctggttcgagagtacttttcctgggagggggc

SEQ ID NO: 4128 - DNA, 458 bp, Homo sapiens
cagaaggggctttcacattcgggaagcgtcgggattaggtgaaagtacgtagttgtctttcgtaagttaaaatgataattgggccgaaacttactgccttacctaaaaggtagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaactgtcagtttgagccagatggaagctgagctgaacacattacgatggatgatggaaacataagactatcaagaaatccaagtggtaatg

SEQ ID NO: 4129 - DNA, 509 bp, Homo sapiens
ggataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagca

SEQ ID NO: 4130 - DNA, 518 bp, Homo sapiens
cttgcattttagctaatttaggagttttgagaatgtattggatacgctccagtacataaggagttgccgcatattatatcagactgctttgagaaatctcatccgtagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctg

SEQ ID NO: 4131 - DNA, 329 bp, Homo sapiens
gctcttttccggttagcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactg

SEQ ID NO: 4132 - DNA, 357 bp, Homo sapiens
gctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgatgttgacaaggtcacaggcaggtttaatggccagtttaaaacttatgctatctgcggggccattcgtaggatgggtgagtcagatgattccattctccgattggccaaggccgatgacatcgtctcaaagaacttttgactggagagaatcacagatgtggaatatttgtcataaataaataatgaaaacct

SEQ ID NO: 4133 - DNA, 340 bp, Homo sapiens
gatccccatcccgtggagtggccggcgacaagatggcagcagcgtgtcggagcgtgaagggcctggtggcggtaataaccggaggagcctcgggcctgggcctggccacggcggatcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatctcggtggctagcaagacgtacaactt

SEQ ID NO: 4134 - DNA, 238 bp, Homo sapiens
tcattgatctcttcctgggggcctctctcaaggatgaggtcctgaatattatgccagggcataagcagacccgtgccggccagcgcaccaggttcaaggcatttgttgctgtcggggactacaatggccacgtcggtctgggtgttaagtgctccacggaggtggccaccgccctccgaggggccatcatgctggccaagctctccatcgtccccgtgcgcataggctactgggggaa

SEQ ID NO: 4135 - DNA, 429 bp, Homo sapiens
ggaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagac

SEQ ID NO: 4136 - DNA, 352 bp, Homo sapiens
cgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacc

SEQ ID NO: 4137 - DNA, 436 bp, Homo sapiens
gctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcc

SEQ ID NO: 4138 - DNA, 379 bp, Homo sapiens
agaaccattaatagcaataggagacgggcgcggtggctcatgcctgtaatcccagcactttgggaggccaaggcagatggatcacctgaggtcggcagttcaagaccagcctgaccaatatggagaaaccctgtctctactaaaaatacaaaattagctgggcacggtggcgtgtgcctgtaatcccagctacttgggaggctgaggcaggagaattgcttgaacctgggaggcggaggttgccgtgagccgagattgtgccattgcaccccagcctgggcaacaagagcgaaactgcgtctcaaaaacaaacaaacaaacgcaaaaggagggagatcaagtgcagaaataaaattgggaaaaacttatattaaagaaa

SEQ ID NO: 4139 - DNA, 455 bp, Homo sapiens
accattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgttttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatgg

SEQ ID NO: 4140 - DNA, 385 bp, Homo sapiens
atccttcttgacataaagactcgacttgaacaggaaattgctacttaccgccgacttctggaaggagaagacgtaaaaactacagaatatcagttaagcaccctggaagagagagatctaaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatctggctataatcttatctttgctccctgcaagaaatcagccataagaaagcactattaatactctgcagcgattagaaggggtggggtggcgggaatcctatttatcagactctgtaattgaatataaat

SEQ ID NO: 4141 - DNA, 445 bp, Homo sapiens
ggccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgccccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagccc

SEQ ID NO: 4142 - DNA, 508 bp, Homo sapiens
gagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtc

SEQ ID NO: 4143 - DNA, 491 bp, Homo sapiens
ctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaattgaacaaagcacctaagatgcgccgccggacctacagagctcatggtcggattaacccatacatgagctctccctgccacattgagatgatccttacggaaaa

SEQ ID NO: 4144 - DNA, 503 bp, Homo sapiens
atggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaag

SEQ ID NO: 4145 - DNA, 352 bp, Homo sapiens
  misc_feature 352: n = A,T,C or G
gctctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctn

SEQ ID NO: 4146 - DNA, 511 bp, Homo sapiens
ggtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcat

SEQ ID NO: 4147 - DNA, 306 bp, Homo sapiens
ccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacgagaaaaactccttgtggtgaaggttctaagacgtgggatcgtttccagatgagaattcacaagcgactcattgacttgcacagtccttctgagattgttaagcagattacttccatcagtattgagc

SEQ ID NO: 4148 - DNA, 505 bp, Homo sapiens
ggggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcat

SEQ ID NO: 4149 - DNA, 421 bp, Homo sapiens
tgaaggatttgaagctgcaaaggaaaaggcccttcagtttttaggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactctt

SEQ ID NO: 4150 - DNA, 537 bp, Homo sapiens
atctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggaaaagatgcggccgcaagcttattccctttagtgagggttaattttagcttggcactggccgtcgttttacaac

SEQ ID NO: 4151 - DNA, 281 bp, Homo sapiens
cgttatgagatcaagatgaccaagatgtataaagggttccaagccttatgggatgccgctgacatccggttcgtctacacccctgccatggagagtgtctgcggatacttacacaggtcccacaaccgcagcgaggagtttctcattgctggaaaactgcatgatggactcttgcacatcactacctgcagttttgtggctccctggaacagcctgagcttagctcagcgccggggcttcaccaagacctacactgttggctgtgaggaatgcacagtgtt

SEQ ID NO: 4152 - DNA, 461 bp, Homo sapiens
gtaaatagccgcagcctgtgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagcgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatgggggtggttttgcattaaatcctggggtccattttac

SEQ ID NO: 4153 - DNA, 327 bp, Homo sapiens
cactgcaaggtccacctcccgggttcacgccattctcctggctcagcctcctgagtagctgggactacaggcgcccgccaccatgaccggctagttttttttggatttttagtaaagaaggggtttcaccgtgttagccatgatggtctcgatctcctgacctcgtgatttgtccgcctcagcctcccaaagtgctgactctgtgcgcgggcagttgctaatcggactgatgcgtgcttcattcgagttattggatctgagcttgtacagaaatacgtcggtgagggggctcgaatggttcgtgaactctttgaaatggccacaaca

SEQ ID NO: 4154 - DNA, 500 bp, Homo sapiens
gctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaag

SEQ ID NO: 4155 - DNA, 411 bp, Homo sapiens; identical to SEQ ID NO: 1072

SEQ ID NO: 4156 - DNA, 520 bp, Homo sapiens
aggggctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatg

SEQ ID NO: 4157 - DNA, 345 bp, Homo sapiens
ggcctttttgctgtaagcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacacggtactctgtggatatccccttggacaaaactgtcgtcaataaggatgtcttcagaga

SEQ ID NO: 4158 - DNA, 455 bp, Homo sapiens; identical to SEQ ID NO: 1073

SEQ ID NO: 4159 - DNA, 341 bp, Homo sapiens
catacagactgactcctaaactgatggaagtctgtaaagaaaaggatttttcccctgaagcattgaaaaaagtaaatatcacctttgagtacatgtttgaagaagtgccgattgtaattaaaaattcacatctgatcaatgtcctaatgtgggaactagaaaagaagtcagctgctgcagataaacatgaattgctcagccttgccagcatcaatcatttggggaagaatctacagttgctgatggacagagtggatgaaatgagccaagatatatttaaatacaacacatacatgaggaatactagtaaacaacagcagcagaaacatcagtatcagcag

SEQ ID NO: 4160 - DNA, 462 bp, Homo sapiens
gggtgcacgcgagtgcttctgaaacgtcagctgcgctcccctacgagtgctgagcccgcggaaccgcagccatgactgaggctgatgtgaatccaaaggcctatcgccttgccgatgcccacctcaccaagaagctactggacctcgttcagcagtcatgtaactataagcagcttcggaaaggagccaatggggccaccaaaaccctcagcaggggcatctatgagttcatcgtgatggctgcagacgccgagccactggagatcattctgcacctgccgctgctgtgtgaacacaagaatgtgccctacgtgtttgagcgctccaagcaggccctggggagagcctgtggggtctccaagcctgtcatcgcctgttctgtcaccatcaaagaaggctcgcagctgaaacagcagatccaatccattcaccagtccattgaaaggctcttagtctaaacct

SEQ ID NO: 4161 - DNA, 413 bp, Homo sapiens
tgacctcagtgccatcagcctggatggggagaaggtagatttcaatacgttccggggcagggccgtgctgattgagaatgtggcttctctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgactacctgaaggacaagctcccctacccttatgatgacccattttccctcatgaccgatcccaagctcatcatttggagccctgtgcgcc

SEQ ID NO: 4162 - DNA, 389 bp, Homo sapiens
gctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcatacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctaaccaatggtctggacaacaagctccgtgaagagctggagcgactga

SEQ ID NO: 4163 - DNA, 453 bp, Homo sapiens
tgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaa

SEQ ID NO: 4164 - DNA, 337 bp, Homo sapiens
tgatcaagggttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcggttactctgctagaatttaggtgtgagattttttgtttcccaggtatagcaggcttatgtttg

SEQ ID NO: 4165 - DNA, 341 bp, Homo sapiens
aatgctttttaaagagagtatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtgtatgtttaattatgataccttttcatcccctttaggagcgttttcagattttggttgctaagacctgaatcccatattgagatctcgagtagaacg

SEQ ID NO: 4166 - DNA, 313 bp, Homo sapiens; identical to SEQ ID NO: 1109
  misc_feature 313: n = A,T,C or G

SEQ ID NO: 4167 - DNA, 351 bp, Homo sapiens; identical to SEQ ID NO: 1075
  misc_feature 273: n = A,T,C or G

SEQ ID NO: 4168 - DNA, 336 bp, Homo sapiens
gcctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatgcccgtgtccgcctgctactgagtaaggggcattcctgttacagaccaaggagaactggagaaagaaagagaaaatcagttcg

SEQ ID NO: 4169 - DNA, 370 bp, Homo sapiens
gctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggca

SEQ ID NO: 4170 - DNA, 436 bp, Homo sapiens
gtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattc

SEQ ID NO: 4171 - DNA, 452 bp, Homo sapiens
cccgcctgtgccatatttcgggaggctgcaaggagggctcacagctcgaagaaccatcatcatcaagggctatgtgcctcccacaggcaagagctctgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtacagatctaatctattcctggggccataactcatgggaaaacagaattatccccta

SEQ ID NO: 4172 - DNA, 321 bp, Homo sapiens
gtctaccggcgggatttgatggcgtgatgtctcacagaaagttctccgctcccagacatgggtccctcggcttcctgcctcggaagcgcagcagcaggcatcgtgggaaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaaccccttgaggcc

SEQ ID NO: 4173 - DNA, 414 bp, Homo sapiens; identical to SEQ ID NO: 1076

SEQ ID NO: 4174 - DNA, 411 bp, Homo sapiens
atctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagttagtaatgctttttgagtttcatgttggtttattttcacagattggggtaacgtgcactgtaagacgtatgtaacatgatgttaac

SEQ ID NO: 4175 - DNA, 395 bp, Homo sapiens
tgaggagacagtccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctaaagttccagcaaaaaagatcaccgccgcgagtaaaaaggct

SEQ ID NO: 4176 - DNA, 490 bp, Homo sapiens
gttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggct

SEQ ID NO: 4177 - DNA, 80 bp, Homo sapiens
cgaagtgctgggataacaggcgtgagccaccacacctgacctctgccactaatttttttttttttttttttttttgaaag

SEQ ID NO: 4178 - DNA, 427 bp, Homo sapiens
ggtcttagaatttcactttgaacccaatgaatattttacaaatgaagtgctgacaaagacatacaggatgaggtcagaaccagatgattctgatcccttttctttagatggaccagaaattatgggttggacagggtgccagatagattgcaaaaaaggaaagaatgtcactttgaaaactattaagaagaagcagaaacacaagggacgtgggacagctcgtactgcgactaacacagtttccaatgactctttctttaacttttgagcccctcctgaagttcctgagagtggagatctggatgatgatgctgaagctatccttgctgcagacttcgaaattggtcactttctacgtgagcgtataatcccaacatcagtgttatattttactggagaagctattgaagatgatgatgatgattat

SEQ ID NO: 4179 - DNA, 326 bp, Homo sapiens
  misc_feature 303: n = A,T,C or G
atcagaataagacagagtacaggctgggcacggaggctcatgcctgtaatcccagcaatttgtaaggctgaggtgggaggatcacctgacgtcaggagttcaagaccaacctggccagcatggtgaaacccagtctctgaaaaatacaaaaattacccgggcatgatggcaggtgcctgtaatcccagctattcaggaggttgaggcaggagaatcacttgaaccctggaggcagaggttgcagtgagccgaggttgtgccattgcactccagcctgggcaacagagcaagactccgtctcanaaaaaaaaattaatattattaat

SEQ ID NO: 4180 - DNA, 380 bp, Homo sapiens
tactactgttgcgacatgacgacagacggtgacgagtgcgggcagaccacagctagagtgcgctgcaaaaaaagctctatttgtgacagctgcgatgctactgctttatgtgtcgccattatgagctgcactaaacgggtcagctgcgacaatagcactcattttatgtttctcgttcagggggaggagtgggacgatgtattttctactgcacctgagcaggcaggtcccagatttcttaaggctgtgtttgaccatgtgtctagttacttgctgaaaagtgaatatattttccagcatgtcttgacaacctgtactcttccaatgtcatttatcagttgtaaaatatatcagattgtgtcctcttctgtacaattgac

SEQ ID NO: 4181 - DNA, 463 bp, Homo sapiens
agccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagc

SEQ ID NO: 4182 - DNA, 199 bp, Homo sapiens
gaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacat

SEQ ID NO: 4183 - DNA, 456 bp, Homo sapiens
atcaattaacattttaattggaattttgaattattaggcttttcatttaagtcatctacaaattgattgacaattgaactttatcatttgcttagttcactgctaaatcaaactgtttaatacttttttctaatagtaaaaacatactgaagattgagaagcactggtttagaaaaaatatgtaaatatataaaatgtaatagcctggaaatcaatcagaaaattggaactgattccatttgtaagaacagaaacataaaataagttttaaacttataaaacttttattttaaaattactacaaacctcaatgtaggttataaaagaagacttcaataaatggaaaaacacaccatacttcctgggatgaaaagactcaatgcggtgccttgcaggcatttgtatacatagaggaaactgttttcaaagctgagctgcacttttggtcccctcaag

SEQ ID NO: 4184 - DNA, 248 bp, Homo sapiens
aaaaaaccctgaaatgtttggggtgggggggtgcttttattaaaagaaaaagcctccaacctggctaacatggtgaaaccccgtctctactaaaaatacaaaaaaattaaccgggcgtggtggcgggcgcctgtagttccagctacttgggaggctgaggcaggagaatggcgtgaactcgggaggcggagcttgcagtgagccgagattgcgccactgcactccagcctgggcgagagtgagactct

SEQ ID NO: 4185 - DNA, 468 bp, Homo sapiens
cagaaggggcttttcgatccgccatctgcggtggagccgccaccaaaatgcagattttcgtgaaaacccttacggggaagaccatcaccctcgaggttgaaccctcggatacgatagaaaatgtaaaggccaagatccgggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagatgaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattatt

SEQ ID NO: 4186 - DNA, 453 bp, Homo sapiens
gtccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgg

SEQ ID NO: 4187 - DNA, 452 bp, Homo sapiens
agctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaat

SEQ ID NO: 4188 - DNA, 281 bp, Homo sapiens
gctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctga

SEQ ID NO: 4189 - DNA, 497 bp, Homo sapiens
ggctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggca

SEQ ID NO: 4190 - DNA, 140 bp, Homo sapiens
ctacaagagcccctgcccctctgttggaggcacagttttagaataaggaggaggagggagaagagaaaatgtaaagggagggagatctttcccaggccgcaccatttatgtcactcacatggacccaagataaaagaatg

SEQ ID NO: 4191 - DNA, 373 bp, Homo sapiens
gcttttggaagagttagaagaatttggaaggccttaaatatagtagcttagtttgaaaaatgtgaaggactttcgtaacggaagtagtgcgggatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggag

SEQ ID NO: 4192 - DNA, 386 bp, Homo sapiens
gggagtgattcaggctgggcctgattgctcacgtctgtaatcccagcactttgggaggccgaggcaggcggatcatgaggtcaggagattgagactatcctggctaacacgatgaaaccctgtctctactaaaaatacaaaaaattagccagttgtggtggcaggcgcctgtagtctcagctacttgggaagttgagggaggagaatggtgtgaacccaggaggtggagcttgcagtgagccgagattgtgccactgcactccagcctgggtgacagagtgagaccccgtctcaaaaaaagaaaaaaagtgattcagttaaaatgcagtcattatggtgggctcaatcaaggacatgtggacacagatatgtatgcacatggagga

SEQ ID NO: 4193 - DNA, 450 bp, Homo sapiens
acattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacat

SEQ ID NO: 4194 - DNA, 291 bp, Homo sapiens
gcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaac

SEQ ID NO: 4195 - DNA, 316 bp, Homo sapiens; identical to SEQ ID NO: 1087

SEQ ID NO: 4196 - DNA, 449 bp, Homo sapiens; identical to SEQ ID NO: 1088

SEQ ID NO: 4197 - DNA, 528 bp, Homo sapiens
aggggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaaccccaataccttctgcataatgaattaactagaaataactttgcaaggagagccaaagctaagacccccgaaaccagacgagctacctaagaacagctaaaagagcacactcgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaagccttgcagagagagtaaaaaatttaacacccatagtaggcctaaaagcagccaccaatt

SEQ ID NO: 4198 - DNA, 476 bp, Homo sapiens
gctaaacctagccccaaacccactccaccttactaccagacaaccttagccaaaccatttacccaaataaagtataggcgatagaaattgaaacctggcgcaatagatatagtaccgcacgggaaaggtgaaaaattataaccaagcataatatagtaaggactaacccctataccttctgcataatgaattaactagaaataactttgcaaggagagccaaagctaagacccccgaaaccagacgagctacctaagaacagctaaaagagcacacccgtctatgtagcacaatagtgggaagatttataggtagaggcgacaaacctaccgagcctggagatagctggttgtccaagatagaatcttagttcaactataaatttgcccacagaaccctctaaatccccttgtaaatttaactgttagtccaaagaggaacagctctttggacactaagaaaaaaccttgcaaaga

SEQ ID NO: 4199 - DNA, 529 bp, Homo sapiens
gaaagattctccaataagacacagtagagtctctagccaaaagtgattgaggtcccttcatctctgctgtttgttcaatgtaaattagccatcatcctccctgtttgtttttctcatcttcccacatgggctcaacaccatccttaaaaagtgagtagtcacagccagacattaaattactagacaactggatatggttgtacagagcccaaaagtcaacaggatcaaacttagagatcagcggcaggtttgcttgtcaagttttgcttttatcttttttaaaaaaaccagagtgcccatctgttctgtagaggatgtttaatatagtgttctgggttagcaacctcctgattagattctgttttctcctcttcacagggggattaggagtaggggtggtttctggtttgacagtccgccgtcttacatcgatctgctcctgcttttaactctgctcttgtttcctaccactggcctgggagccagccttttcagttctctcactgacaaactttcagttcttatttat

SEQ ID NO: 4200 - DNA, 476 bp, Homo sapiens
ccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagagaacgtggagaagaaaattgacaaatacacagaggtcctcaagacccacggactcctggtctgagcccaataaagactgttaattcct

SEQ ID NO: 4201 - DNA, 128 bp, Homo sapiens
agaaacctgaagttagaaaggctcaacgagaacaagctatcagggctgctaaggaagcaaaaaaggctaagcaagcatctaaaaagactgcaatggctgctgctaaggcacctacaaaggcagcacct

SEQ ID NO: 4202 - DNA, 297 bp, Homo sapiens
gctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatg

SEQ ID NO: 4203 - DNA, 370 bp, Homo sapiens
gctttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaa

SEQ ID NO: 4204 - DNA, 394 bp, Homo sapiens; identical to SEQ ID NO: 1093

SEQ ID NO: 4205 - DNA, 510 bp, Homo sapiens
gccttttccggaaaaggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactc

SEQ ID NO: 4206 - DNA, 435 bp, Homo sapiens
gagcccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttctagttgatatgtcaagggttcaagatgatgaacttggtgatggcactacctctgttaccgttttagcagcacaattattaagggaagcagaatctttaattgcaaaaaagattcatccaca

SEQ ID NO: 4207 - DNA, 308 bp, Homo sapiens
gctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggg

SEQ ID NO: 4208 - DNA, 110 bp, Homo sapiens
gctttctgggctcggacctaggtcgcggcgacatggccaaacgtaccaagaaagtcgggatcgtcggtaaatacgggacccgctatggggcctccctccggaaaatggtg

SEQ ID NO: 4209 - DNA, 331 bp, Homo sapiens
aggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatac

SEQ ID NO: 4210 - DNA, 332 bp, Homo sapiens
tggcatcacggagggaggacgcctcggctggctggaagcggctcacctgctaaaaagccctcggagccaggcgcggtggctcacgtctataatcccagcactttgggaggccaagacgggcagatcacctgaggtcggggttcgagaccagtctgaccaacatggagaaaccctgtctctactaaaaatacaaaattagctgggcgtggtggcatgcgcctgtagtcccagctactcaggaggctgaggcaggccaattgcttgaacctgggaggcggaggtggcagtgagccaagattgtgccattgcactccagcctaggcagcaagagg

SEQ ID NO: 4211 - DNA, 495 bp, Homo sapiens; identical to SEQ ID NO: 1096

SEQ ID NO: 4212 - DNA, 492 bp, Homo sapiens
ggcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcat

SEQ ID NO: 4213 - DNA, 314 bp, Homo sapiens
gatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagt

SEQ ID NO: 4214 - DNA, 505 bp, Homo sapiens
agttttgctcttgttgcccaggctggagtgcaatggcatggtctcagctcatagcaacctctgcctccagggttcaagcgattctcctgcctcagcctcccgggtagctgggattacaggctcccaccaccacgccctaatttttgtgtttttagtagagacgggttttcaccatgttggccaggctggtcttgaactcctgacatcaggtgatctgcccacctcggcctcccaaagtgctgggattacaggcttgagccttcacgcccggccttctactgccatttttccgaagtcaggtctacatgatttgttgttttatttttagtgtcaattaatagatattcctgagtctctgcagaccagccatttgcatgtcagacctttttttgcatcagaaattaccttgataagcctggacaacttagcaagaccccgtctctgcggaagatgaaaaaattaactgggcgtggtggtgcatgcctgtagtcccagctgctcggca

SEQ ID NO: 4215 - DNA, 403 bp, Homo sapiens
tgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatgggtttctgttcagatcttgcaaagatggaggctagaatctgttggaatctgcttccagtggcccgattggaagtcaccagccaagcaccaactggtcaagaatatcaggtgacatgaggcagccacggaagaagaggaagtaattgcacaccattttccaagaaccaagaaagaagaaaacacaagagatttttctcatcttttttttttttttttggggggggggggggggggggga

SEQ ID NO: 4216 - DNA, 55 bp, Homo sapiens
agaccaagatcataaatattaatggtgaaaacactgtagtaataaattttcatat

SEQ ID NO: 4217 - DNA, 389 bp, Homo sapiens
agtgcccattccaatcgaatgcattatgaccgagattgcagcaggtgtatcctacggctgtgactttaaaaacaggtttaaagtggctgtggttggggacatgaatcctggatgtcagccccctattacacctgacgtggagactttccaaaacaccgtaggagattgcttcggcatcgcaatggttgcatttgcagtggccttttcagttgccagcgtctattccctcaaatacgattattcacttgatggcaatcaggagttaatagccttgggactgggtaacatagtctgtggagtattcaaaggatttgctgggagtactgccctctccagatcatcagttcatgagagcacaggaggcaaaacacaaattgctgggcttattg

SEQ ID NO: 4218 - DNA, 485 bp, Homo sapiens
cagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagacgaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaa

SEQ ID NO: 4219 - DNA, 437 bp, Homo sapiens
agttgcaaatcactgaagacccaactcaaagtgacttaagtcagaaagaaattttatgaattcaggtaattaaaaagtccagaagtatctgcctttaggcacagctggatccaagggcacaaatgatgtcatcaggctccagttattctccatctcccaactcagctttttctgtctgtaagcctgattttcaggaaggctctttcctagtgatggagatgaccaccatcagctccaggcttctatcctgctaacccagtaacccagtgggaagagatttacttattccaataattccaagtggagagtgtcattgacccgtttggggtctcatctctacttctaggggaatgaaacactctgagtggccaggcctgtgtcatgtgctaattcctagagccagggaaataaggtctgaggattcaggatggggtgaa

SEQ ID NO: 4220 - DNA, 339 bp, Homo sapiens
agggggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttttgggggggagaaaaacccaccccccccccccaaaaatat

SEQ ID NO: 4221 - DNA, 440 bp, Homo sapiens
aggggctgcttaagactccagattaaggaaagagaggcctgggcaggcagaaaggaagagaagccggatgtggtggcttgtatcttcaatcccagcatcttttagaggccaaggtgggaggatcacttgagcccaggagttcaaaaccagccttgggcaacatagcgagactcccatctctccaaaaaaaatttaaaaaccagccaggtatactgggcgcagtggctcacgcctgtaatcccagaactttcggaggccgaggcaggcagatcacgacgtcaagagttagagaccagcctgaccaacatggagaaaccccgtctctactaaaaatacaaaacttatccaggcctgcggtgatgcgcacctgtagtctcagctactcaggaggctgaggcatgataatcgcttgaacccgggagacagaggttgcactgagc

SEQ ID NO: 4222 - DNA, 478 bp, Homo sapiens
ggaggccgggcgtcttcggtcatctccggcgcttctagggctggttcccgtcatcttcgggagccgtggagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaag

SEQ ID NO: 4223 - DNA, 379 bp, Homo sapiens
ggaagaggatggagatgaagatgaggaagctgagtcagctacgggcaagcgggcagctgaggatgatgagaatgacgatgtcgataccaagaagcagaagaccgacgaggatgactagacagcaaaaaaggaaaagttaaactaaaaaaaaaaaggccgccgggacctattcaccctccacttcccgtctaaaaatctaaacggggtcaccttcaagtaaagaggcccgcccgcccaccgggggcagggccacccgcaaatgacacgcgctttccaccacccaacccaaaccatgaaaatttgcaccaggggaggaaaaaagacccaaaccttccaaggccctgctttttttcttaaaagtactttaaaaaggaaattg

SEQ ID NO: 4224 - DNA, 328 bp, Homo sapiens
accacgcttttcatctgtcccgctgcgtgttttcctcttgatcgggaactcctgcttctccttgcctcgaaatggaccccaactgctcctgctcgcctgttggctcctgtgcctgtgccggctcctgcaaatgtaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttttt

SEQ ID NO: 4225 - DNA, 444 bp, Homo sapiens
ggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaa

SEQ ID NO: 4226 - DNA, 507 bp, Homo sapiens
gagtcttggctggcagacctgtactccgtactccgtacttcgcagtcgcagcggcgcggtcttcggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagatgctgaacaccccaggcctgctgaggtccctccttgagtctcatgttcaagcagtctttgtacatgaaactgggaggcgaccgtgttagctgccagttactgacagacacctctcaccagtggcttcactctgtgtccctgacccagcacatggcacatgagtgcctgccatccgccagagtttctacagcagcaatcccaagatgctggagctagaggggacctgacctgatagaagataccttcagtggctgacaagctgttccttggaacctgtgcagggatgaggcc

SEQ ID NO: 4227 - DNA, 452 bp, Homo sapiens
cgatctcatttatgatcccataaaaactgcccaaggatctctctcactaaaggcatacagactgactcctaaactgatggaagtctgcaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgctgcagataaacatgaattgctcagccttgccagcagcaatcatttggggaagaatctacagttgctgatggacagagtggatgaaatgagccaagatataggtaaatacaacacatacatgaggaatactagtaaacaacagcagcagaaacatcagtatcagcagcgtcgccagcgggagaatatgcagcgccagagccgatgagaacccccgctccctgagg

SEQ ID NO: 4228 - DNA, 364 bp, Homo sapiens
acagaagggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacgggtgcttgaactttattgaggaaaatgatgaagttctgggtgctggatttggtcgcaaaggtcatgctgttggtgatattcctggagtccgcttt

SEQ ID NO: 4229 - DNA, 313 bp, Homo sapiens
gatccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataaaggctgctgtttcgacgacaccgttcgtggggtcccctggtgcttctatcctaataccatcgacgtgcctccagaagaggagtgtgaattttagacacttctgcagggata

SEQ ID NO: 4230 - DNA, 370 bp, Homo sapiens
agtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcttattttttgatacgcactttgcaggatgac

SEQ ID NO: 4231 - DNA, 309 bp, Homo sapiens; identical to SEQ ID NO: 2802

SEQ ID NO: 4232 - DNA, 426 bp, Homo sapiens
gcttcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctgg

SEQ ID NO: 4233 - DNA, 485 bp, Homo sapiens
cagaagggtttgtcttgtaggtttgcttataatatgtattacaaagctaagttgtagagtggacatttccatttatattttgtagatattgactgcttctctttattttcttttttttaaattttattttaaagacagaatcttgctgtgtcacccaggctggagtgcagtggtgtgatctcggctcactgcagcttctgcctcccaggttcaagcaattctgcttcagccacccaagttgctgggattacaggcacatgccaccacgcctggctaatttttgtacttttagtagagacagagtttcaccatattgaccaggctggcctcaaactcctgacctcaagtgatctgcccatctcggcttcccaaagtgctgggtttacaggcatgagccaccacacctggccaatattgactgcttttgataagatcagttgcaattttgattatatagtaaaccaaatctggtatccaataataat

SEQ ID NO: 4234 - DNA, 482 bp, Homo sapiens
cagaaggggaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgat

SEQ ID NO: 4235 - DNA, 527 bp, Homo sapiens; identical to SEQ ID NO: 1103

SEQ ID NO: 4236 - DNA, 329 bp, Homo sapiens
  misc_feature 228, 229, 230, 231, 232, 233, 234, 235, 236, 237, 239, 241,242, 243, 244, 245, 246, 247, 248, 249, 251, 252, 253, 254,255, 257, 259, 262, 263, 264, 265, 266, 267, 268, 269, 271,272, 273, 274, 275, 276, 278, 279, 280, 281, 283, 284: n = A,T,C or G
  misc_feature 286, 292, 294, 295: n = A,T,C or G
ggcgcgatctcggctcactgtaagctccgcctcctgggttcacgccattctcctgcctcagcctccagagtagctgggactacaggcgccagccaccacgcccggctaattttttttgtatttttagtagaaacggggtttcaccgcgttagccaggatggtctccatctcctgacctcgtgatccacctgcctcagcctccaaaagtgctgggattataggggtgannnnnnnnnncncnnnnnnnnncnnnnnananccnnnnnnnnannnnnntnnnncnncnacaccncnnccctcccctatttccaccactcctccttaaatcc

SEQ ID NO: 4237 - DNA, 337 bp, Homo sapiens
ctcgctccgagtttcaggctcgtgctaagctagcgccgtcgtcgtctcccttcagtctccatcatgattatctaccgggacctcatcagtcacgatgagatgttctccgacatctacaagatccgggagatcgcggacggtttgtgcctggaggtggaggggaagatggtcagtaggacagaaggtaacattgatgactcactcattggtggaaattcctccgctgaaggccccgagggcgaatgtaccgaaagcacactaatcactggtgtcgatattgtcatgaaccatcacctgcaggaaacacgtttcacaaaagaagcctacatgaagtaca

SEQ ID NO: 4238 - DNA, 487 bp, Homo sapiens
cagaaggggggggagtgaacggagagcgtagtgaccatcatgagcctcctcaacaagcccaagagtgagatgaccccagaggagctgcagaagcgagaggaggaggaatttaacaccggtccactctctttgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgttttttaa

SEQ ID NO: 4239 - DNA, 212 bp, Homo sapiens
ggagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtc

SEQ ID NO: 4240 - DNA, 84 bp, Homo sapiens
gagcagtggtgtgtgagagccaagcgtccctctggctgcccactcagtggcaacacccgggagctgttttgtcctttgtggagc

SEQ ID NO: 4241 - DNA, 364 bp, Homo sapiens
caatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaa

SEQ ID NO: 4242 - DNA, 95 bp, Homo sapiens
gacatttgcttctgacacaactgtgtgcactagcaacctctaactgacaccatggtgcacctgactcctgaggagaagcctgccgttactgccct

SEQ ID NO: 4243 - DNA, 402 bp, Homo sapiens
ggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcagtggaaccagcagtgacgttggtggttatgaccatgtctcctggtaccaacaacacccaggcaaagcccccaaactcataatttctgatgtcagtaatcggccctcaggggtttctaatcgcttctctggctccaaatctggcaacacggcctccctgaccatctctgggctccaggctgaggacgaggctgattattactgcagctcatatacagacagcagcactcttgtgcta

SEQ ID NO: 4244 - DNA, 440 bp, Homo sapiens
gacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaatccgcagaccttgtgatattccagttccccctgcagt

SEQ ID NO: 4245 - DNA, 461 bp, Homo sapiens
ggagcttttccgtgctacctgcagaggggtccatacggcgttgttctggattcccgtcgtaacttaaagggaaattttcacaatgtccggaacccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatctaggcagccttccgggagccacggcttcttgtggttactgacc

SEQ ID NO: 4246 - DNA, 381 bp, Homo sapiens
gctctcgagtccgggccgcaagtcccagactctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacat

SEQ ID NO: 4247 - DNA, 70 bp, Homo sapiens
ctaactttaacaacatccctaatacaactgtttattcaaatgcacggtggtccctgttagagttagacct

SEQ ID NO: 4248 - DNA, 399 bp, Homo sapiens
gactacgacttccacgtgcacccactgcctcttcccttctcgcttgggaactctagtctcgcctggggttgcaatggaccccaactgctcctgtgccgctggtgtgtcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcaggacagccctgctcccaagtacaaatagagtgacccgtaaaatccaggattttctgttttttgatacaatcttgacccctttgctacattcctttttttctgtgaaatatgtgaataataattaaacacttagac

SEQ ID NO: 4249 - DNA, 438 bp, Homo sapiens
gaaggggctttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggccgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttg

SEQ ID NO: 4250 - DNA, 370 bp, Homo sapiens
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgcgctttccttatcgaggagcagaaaatcgttgtgaaagtgttgaaggcacaagcacag

SEQ ID NO: 4251 - DNA, 509 bp, Homo sapiens
cgacagaagggattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatgcaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatat

SEQ ID NO: 4252 - DNA, 446 bp, Homo sapiens
gaaggcccaagatggctgtcttcgccttagtactcgtgtgaagttggcagggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaat

SEQ ID NO: 4253 - DNA, 446 bp, Homo sapiens
atgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttaaaccccttttttggggaacaaggcttttttaactttttaaaa

SEQ ID NO: 4254 - DNA, 495 bp, Homo sapiens
cttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttgga

SEQ ID NO: 4255 - DNA, 511 bp, Homo sapiens
cacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacagaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttga

SEQ ID NO: 4256 - DNA, 477 bp, Homo sapiens
acttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctg

SEQ ID NO: 4257 - DNA, 500 bp, Homo sapiens
tcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaat

SEQ ID NO: 4258 - DNA, 509 bp, Homo sapiens
atttaatacgactactatagggaatttggccctcgaggccaagaattcggcacgaggagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgat

SEQ ID NO: 4259 - DNA, 694 bp, Homo sapiens
actcactatttggaatttggccctcgaggccaagaattcggcacgagaaagattgctcaagtaggtgcaaaatatgattggactaagcagcctttctcctccggaaggacagactgcttagtccaatcatagtttcttaaagaaaacaaggaattatatttattcataaattcttcctcccataacaccgtcacctccctctttccagactaatggtagagcctgagagtagggtttggagatacgggttaccccaggcagtgggctgagatccactgggaccacaggctcttcctcacctaaatcgctgtcaccctcatccctgtgcctcagtgccatgtggcactgcttcccaaggactcacagctgagtacatgaccatcttgaggggcagccccaggcgctggacccgggagaagtttgcaaggatagcattcagcaggatccctgaggatgggaaaaaagagcttagactctcccagaggaaggcaccccagcctcccagacccacacctcaccccctgtcagctgggccttctctgctgcccggggtgggcccacgtgggctccaatatccaaagccgagatctgggcaagagtccgcaggacatctggggaggcccaggctggtagtggaagaccgtgggcttgctgtggggagacaggacagatggaccatcctgagccctcgagt

SEQ ID NO: 4260 - DNA, 404 bp, Homo sapiens
gctctcgctcgggttttctgccgtcatcttggttccgagttccctgcacagcctcctttttattcccttccttcagaaatgcccggcgaagccacacaaaccgtccctgctacagagcaggagttgccgcacccccaggctgatacagggtctggaacagaatctgacagcgatgaatcagctaccagatcttgaagaacaggattccacccacgcaaccacacaacatgcccagctggcggcagcagctgaaatcgatgaagaaccaggcagcaaagcacaacagagtcggagtgaaaagaaggcaccgaatgctatgtgcaaactgggtcttctgcaggttacaggagttactagagtcactatccggaaatctaagaatatcctctttgtcatcacaaaac

SEQ ID NO: 4261 - DNA, 507 bp, Homo sapiens
gacagaaggggctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgt

SEQ ID NO: 4262 - DNA, 498 bp, Homo sapiens
cagaagggggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagcccc

SEQ ID NO: 4263 - DNA, 220 bp, Homo sapiens
aaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaataaaaataaacagggg

SEQ ID NO: 4264 - DNA, 497 bp, Homo sapiens
agaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttataatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgctttttctgggaaagcagttttgctaaaagctgtacagactttttcttttgtacctagcagtactttatatagtatagctttgggccatgtagcattttaagactcaattttaaaa

SEQ ID NO: 4265 - DNA, 502 bp, Homo sapiens
gaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggagga

SEQ ID NO: 4266 - DNA, 338 bp, Homo sapiens
ctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctct

SEQ ID NO: 4267 - DNA, 338 bp, Homo sapiens
cgattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaacc

SEQ ID NO: 4268 - DNA, 333 bp, Homo sapiens
  misc_feature 307: n = A,T,C or G
gtctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagatcgctgtccactgcacagttcgaggggccaaggcagaagaaatcttggagaagggtctaaaggtgcgggagtatgagttaagaanaaacaacttctcagatactggaaact

SEQ ID NO: 4269 - DNA, 332 bp, Homo sapiens
gactacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccg

SEQ ID NO: 4270 - DNA, 333 bp, Homo sapiens; identical to SEQ ID NO: 1110

SEQ ID NO: 4271 - DNA, 395 bp, Homo sapiens
atgtcacgaggtcgatctatcgatcagttgggacagggcagaaacaagtcataatggaatgtcataaggttggttaatcagttaagacagaagctggaggctgggtgcggtggctcacacctgtaatcccagcactttgggaggccgaggtgggcagatcacgaggtcaggagatcgagaccatcctggctaacatggtgaaaccctgtctctactaaaaatgcaaaaatttgccaggtgtggtgacgggcgcctgtagtcccagctactcaggaggctgaggcaggagaatggcgtaaacccaggaggtggagcttgcagtgagccaagatcacgtcactgcactccagcttgggcgacagaacaagactctgtctcatttaaaaaaaaaagga

SEQ ID NO: 4272 - DNA, 443 bp, Homo sapiens
caacattctgactgggaaccccctttctgaaccataaacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctataaatccccttgtaaatttaactgttagtccaaagaggaacagctctttggacactaggaaaaaac

SEQ ID NO: 4273 - DNA, 371 bp, Homo sapiens
agcagagtgagaccctgtctcaaaaataaataagtaaataaataaataaataaaataaaaaccaggtcagtacctggagaatttgaatgatagagaatgatagagtaataccctaattattagttaaaacctacaggccgggtgtggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttg

SEQ ID NO: 4274 - DNA, 518 bp, Homo sapiens; identical to SEQ ID NO: 2554

SEQ ID NO: 4275 - DNA, 381 bp, Homo sapiens
ttgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccgc

SEQ ID NO: 4276 - DNA, 446 bp, Homo sapiens
cagaaggggctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctc

SEQ ID NO: 4277 - DNA, 409 bp, Homo sapiens
cagaaggggctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcg

SEQ ID NO: 4278 - DNA, 120 bp, Homo sapiens
gcaggtctgatccaacttcgtatgcagggtacattgaagaccttaagaagtttctaaaaccatctactttagaagaacagaagaacctcacagtctgtcctgatggagcactttttgaac

SEQ ID NO: 4279 - DNA, 195 bp, Homo sapiens
gctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtgcctcatcatcaataccttctat

SEQ ID NO: 4280 - DNA, 502 bp, Homo sapiens
gacctctctccggtggtggagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgattgcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgc

SEQ ID NO: 4281 - DNA, 450 bp, Homo sapiens
cagcctatggggtagccctgctccacagttgcggttgtacactgctgcttcaataaaagttgctgtttaacactaccagctcacccttgaattctttcctgggtgaagctaagaaccctcccacgctaatccgcgattttggggcttgcctgtcctttcaataggacattgctaaattgctctctagaattgcttttccaggttgggcgcagtggctcacatctgaaatcccagcactttgggaggctgaggcaggcagatcacctgaggtcaggtgttcaagaccagcctggcctacatggcaaatccctgtctttactaaaaatacaaaaattagctgcgcatggtggcctatgcctgtaatcccagctacttgggtggctgaggcaggagaatcgcttgaacctggaaggtggagcttgcagtgagccgagatcgcgccactgcact

SEQ ID NO: 4282 - DNA, 390 bp, Homo sapiens
aggtggagtctccctgttgcccaggttggagtgcagcggcacaatctcagctcactgcaacctctgcctctggggttcaagcgattctcctgcctcagcctccagagtagctgggattacaggcatgcgccaccacaccaggctaattctgtacttttagtagagatggggtttcaccatgttaaccaggctggtctcaaattcctgacctcaggtgatccgcccatctcagcctctgaaagtgctgggactacacgcatgatccaccttgccctgccctaatagaggttgtttaaaaaatactcaaacaggctgttggtgttatctaacacctagtgggcccagctcctttgacatgtccaaagttgggcgggtatttcttgagctgag

SEQ ID NO: 4283 - DNA, 305 bp, Homo sapiens
gacgacagaagggggccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagtagaccaaaaggatggctcagcaagtgaagtacccagtgaactctctgaacgcccaaaaggattttatgtggaaacagttgtcacatataaagaagattttgttccaaatacagaaaagatcctcaactatt

SEQ ID NO: 4284 - DNA, 516 bp, Homo sapiens
atgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctac

SEQ ID NO: 4285 - DNA, 186 bp, Homo sapiens
ttgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaa

SEQ ID NO: 4286 - DNA, 388 bp, Homo sapiens
gatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaatggtaagtttagtgag

SEQ ID NO: 4287 - DNA, 404 bp, Homo sapiens
tgggcgcggtggctcacgcctgtagtcccagtactttcggaggccgaggtgagtggatcacttgaggtcaggagttcgagaccagcctggccaacacagcgaaaccccatctctactaaaaatacaaaaattatccaggtgtggtggcaggcggcaggcacctgtaatcctagctactcaggaggctgaggcaggagaatcacttgagcctggaaggcggaggttgcaatgagctaaaattgtgccagtgtactccagcctgggtgacagagtaagactccatctaaaaaaaaaatggggtcaagaatgacttcaagctttttgacttgggtgggtagtgtggtattaagaaatacagggaataaaagaataggttacgtgaacaggattggaaaatgatttat

SEQ ID NO: 4288 - DNA, 324 bp, Homo sapiens
gtggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctg

SEQ ID NO: 4289 - DNA, 520 bp, Homo sapiens
taaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaag

SEQ ID NO: 4290 - DNA, 478 bp, Homo sapiens
ctttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatc

SEQ ID NO: 4291 - DNA, 524 bp, Homo sapiens
gcttttcacaagatggcgccgaaagcgaagaaggaagctcctgcccctcctaaagctgaagccaaagcgaaggctttaaaggccaagaaggcagtgttgaaaggtggccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaaccggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatat

SEQ ID NO: 4292 - DNA, 448 bp, Homo sapiens
gatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttatgggatgccgctgacatccggttcgtctacacccccgccatggagagtgtctgcggatacttccacaggtcccgcaaccgcagcgaggagtttctcattgctggaaaactgcaggatggactcttgcacatcactacctgcagttgtgtggctccctggaacagcctgagcttagctc

SEQ ID NO: 4293 - DNA, 392 bp, Homo sapiens
caaccttgacaaatagaattataggagcttacatgttctgattgatagatgagcagactttacaataaaaattataaaaggtagatagatattttatgcttgcattagaaaatatgtaggccaaccaggcagtggctcatgcctgtaatcccaacactttgggaggccaaggtgggcggatcacttgaggttgggagttcaagaccagcctggccaaattggtgaaaccccatctctactaaaaatacaaacattagccgggcatggtgacagccgcctgtagtcccagctactcgggaggctgaggcatgagagccgcttgaaccctggagtgcagtggcgtgatcatggctcactgcagccttgacctcccaggctcaggtgatcctccc

SEQ ID NO: 4294 - DNA, 421 bp, Homo sapiens
gcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgactaagaaatcatggccttcacacagcccataaagcatgacagattaccaaagaagattctgccacatttgattatatactatgtatggatgaaagcactctgagagatttgaatagaaaaagtaatcaagttaaaacctgcaaagctaaaattgaactacttgggagctatgatccacaaaaacaacttattattgaagatccctattatgggaatgact

SEQ ID NO: 4295 - DNA, 409 bp, Homo sapiens
atggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacactgctgcggtgggcggggtcttcgacgtctccaacgctgaccgcctgg

SEQ ID NO: 4296 - DNA, 466 bp, Homo sapiens; identical to SEQ ID NO: 1118

SEQ ID NO: 4297 - DNA, 497 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgac

SEQ ID NO: 4298 - DNA, 436 bp, Homo sapiens
gctctttccctgccgccgccgagtcgcgcggaggcggaggcttgggtcgttcaagattcaacttcacccgtaacccaccgccatggccgagtaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggatgccctttgtgctgaacaccaaatcaacctaattaaggttgatgacaacaagaaactaggataatgggtaggcctttgtaaaattgacagagaggggaaaccccgtcaagtggttggatgcacttgtgtagtaggtaaggactatggcaaggagtct

SEQ ID NO: 4299 - DNA, 498 bp, Homo sapiens; identical to SEQ ID NO: 1122

SEQ ID NO: 4300 - DNA, 495 bp, Homo sapiens; identical to SEQ ID NO: 1123

SEQ ID NO: 4301 - DNA, 556 bp, Homo sapiens
cagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaac

SEQ ID NO: 4302 - DNA, 150 bp, Homo sapiens
aagatattgttcttgttaacattgtattacaacattagccccaaatatagtaagatctatactagataatcctagatgaaatgttagagatgctatatgatacaactgtggccatgactgaggaaaggagctcacgcccagagactgggc

SEQ ID NO: 4303 - DNA, 304 bp, Homo sapiens
gctttttgaggaagacgcggtcgtaagggctgaagatttttggtccgcacgctcctgctcctgactcaccgctgttcgctctcgccgaggaacaagtctgtcaggaagcccgcgcgcaacagccatggcttttaaggataccggaaacacccgtggagccggaggtggcaattcaccgaattcgaatcaccctaacaagccgcaacgtaaaatccttggaaaaggtgtgtgctgacttgataagaggcgtaaaagaaaagaatctcaaagtgaaaggaccagttcgaatgcctaccaagacttt

SEQ ID NO: 4304 - DNA, 424 bp, Homo sapiens
gttctggcggctccagcgcatgctgtccctgctgctttgattccaggtgattgtattttttttatttttttattttttttgagacggagtcttgctctgttgcccaggcaggagtgcagtggcgcatctcggctcactgcaacctttgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcatcctcccaaagtgctgggattataggcgtgagccaccgtcctcagctgattccaggcgaattcttctctgatgggcgggcgatggtgtgttcgtgtgatgagttggagtgtgtgtgtctg

SEQ ID NO: 4305 - DNA, 441 bp, Homo sapiens
gacagaaggggggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtc

SEQ ID NO: 4306 - DNA, 518 bp, Homo sapiens
cagaaggggcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatg

SEQ ID NO: 4307 - DNA, 453 bp, Homo sapiens
agatggcttattcaaacctccttagagctaacatggatgggttgaagaagagagactaaatgaacaaaactaagaagaccaaagcagcagcagcagcagcagcagcagcacctgccgcagcagcaacagcagcaacaacagcagcaacaacagcagcaacagcagcacagtgaagggcatacatttcctgctttcaccaattaaccactgaattgctattttttccttgtggccagatagctaggtttctggctcccccacaggaggtgtgttcacataagattagggtcctttcggaaagaataggtgcagtgtttataggatagttgtggtaagaatctagtttattttgcatatggctaattggtctgtgctgcatggttatatactcctggattatagattaaaagtctctgtagacatctctgtgaagagcaagctatcattaaacat

SEQ ID NO: 4308 - DNA, 510 bp, Homo sapiens
ggggccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctg

SEQ ID NO: 4309 - DNA, 523 bp, Homo sapiens
aatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgattttttttaattgcaaagactaggtgtatatttttttctgtttttctaaatgacccgttacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactctta

SEQ ID NO: 4310 - DNA, 328 bp, Homo sapiens
agaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaaga

SEQ ID NO: 4311 - DNA, 203 bp, Homo sapiens; identical to SEQ ID NO: 1133

SEQ ID NO: 4312 - DNA, 333 bp, Homo sapiens; identical to SEQ ID NO: 1134

SEQ ID NO: 4313 - DNA, 451 bp, Homo sapiens; identical to SEQ ID NO: 1136

SEQ ID NO: 4314 - DNA, 307 bp, Homo sapiens
tacatgcatagctgggactgtaggtggcaccactacacctggctccttttccatacttaccagctgtatgtattcctgaaaatttataagaatttttagctgggagcggtggctcacacctgtaatcccagcactttggaaggtcgaggcgggtggatcacctgaggtcaggagttcaagaccagcttgaccaacatggtgaaaccctgtctctactaaaaatacaaaaattggccgggtgtggtggctcacgcctataatcccagcactttgggaggccgaggcgggcggatcacaaggtcaggag

SEQ ID NO: 4315 - DNA, 488 bp, Homo sapiens
ggttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctataggtgagagcagctcaccccactaccagactctgtgt

SEQ ID NO: 4316 - DNA, 316 bp, Homo sapiens
ctctcccctgggtcttaaattacagtaacatcggccaggcgcggtggctcacgcctgtaatcccagcactttgggaggccgaggagggcggatcacgaggtcaggagatcgagaccatcctgtataacacggtgaaatcccgtctctactaaaaacacaaaaaattagccaggcgtggtggcaggcgcctgtagtcccagctactcgggaggctgaggcaggagaatggcatgaacccgggaggcggagcttgcagtgaaccgagatcatgccactactgcactccagcctgggtgacagagtgagactcagtccc

SEQ ID NO: 4317 - DNA, 384 bp, Homo sapiens
gatgagttataggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtcttacctatcctgccctca

SEQ ID NO: 4318 - DNA, 399 bp, Homo sapiens; identical to SEQ ID NO: 1138

SEQ ID NO: 4319 - DNA, 447 bp, Homo sapiens
cgcacgccttcgccgtagcatctttcgcagcggaccgaagagaagaaaataggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggacgtggaaacatctttc

SEQ ID NO: 4320 - DNA, 505 bp, Homo sapiens; identical to SEQ ID NO: 1140

SEQ ID NO: 4321 - DNA, 209 bp, Homo sapiens
cgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctaa

SEQ ID NO: 4322 - DNA, 410 bp, Homo sapiens
gccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtgga

SEQ ID NO: 4323 - DNA, 571 bp, Homo sapiens; identical to SEQ ID NO: 1143

SEQ ID NO: 4324 - DNA, 497 bp, Homo sapiens
gaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgc

SEQ ID NO: 4325 - DNA, 320 bp, Homo sapiens
taagctcggaattcggctcgaggccgtaaagtgaaagagaccggaccagcttcagctttcggactctggttcttggatcgtgtcctctccccctcgccgccctcttcccccaatctgagccattgcaggcctctgcctgctgccccctctctcctcgggatcgggtccccagagccaccatctcctgagcctcccaccccgctgcctgggccctgtggttgctgggcctcccacctcaaggaggggaaggttgtacagcccgaacccgtggagcaatgccctgtctggcctccaaaaccaaaataaaactgggtcacttt

SEQ ID NO: 4326 - DNA, 422 bp, Homo sapiens
cgtacgtaagctcgggaattcggctcgagtcggaagctgctggggcattaggactcatgtgctttctgctccacagtttcagatgccactgcactactaactccccagtgcttttgaggcacgtgttagacatgttctcctctgttggaagtccttgtggcaacttcaagggcttgattcttatcaaatgcttaactactttcaattttgcattcactgaagggatattcttgtgaacttgaggggtatgtgctttttctaatccaagcatctttattatatctttttcccaatatggacgtcttcttgtactttttattctggtaacaatatgcagtttatgagggttctgtggatccccacctcgagccgctcgagccgaattcccgagcttggatcctctagagcggccgccgactagt

SEQ ID NO: 4327 - DNA, 439 bp, Homo sapiens
accaccatcagctccaggcttctatcctgctaacccagtaacccagtgggaaagagatttacttattccaataattccaagtggagagtgtcattgacccgtttggggtctcatctctacttctaggggaatgaaacactctgagtggccaggcctgtgtcatgtgctaattcctagagccagggaaataaggtctgaggattcaggatggggtgaaaggtggttgcttaaaggaaaatgaaatacaattagcagaataaggggaaacgagtggtctgctctgctcgggcaaaacaagagatgcccattactgtgagggacccttgaagtctggactcttaaatgggtttttgctgatttcctgggtgcatgctaggatgatggggcttgatgcagtagggaagagacgatgtaaaaataataaacaatatataccttc

SEQ ID NO: 4328 - DNA, 459 bp, Homo sapiens
cctcttccccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgttgatgagctatccactctccgaagggcaactggaccagaagacagccatgtcactcctgtggaagtcctatccccttgtttgcattgct

SEQ ID NO: 4329 - DNA, 427 bp, Homo sapiens
tgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgtaaa

SEQ ID NO: 4330 - DNA, 475 bp, Homo sapiens
  misc_feature 405: n = A,T,C or G
tcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattntgaccatcatctgttacctgggcctgccccgcctggaattctaccgctactaccagcagctcaagcttga

SEQ ID NO: 4331 - DNA, 524 bp, Homo sapiens
tgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccag

SEQ ID NO: 4332 - DNA, 624 bp, Homo sapiens
gcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactg

SEQ ID NO: 4333 - DNA, 284 bp, Homo sapiens; identical to SEQ ID NO: 3318
  misc_feature 52: n = A,T,C or G

SEQ ID NO: 4334 - DNA, 422 bp, Homo sapiens; identical to SEQ ID NO: 3319

SEQ ID NO: 4335 - DNA, 575 bp, Homo sapiens; identical to SEQ ID NO: 550

SEQ ID NO: 4336 - DNA, 461 bp, Homo sapiens
agtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgccgactagt

SEQ ID NO: 4337 - DNA, 596 bp, Homo sapiens; identical to SEQ ID NO: 3321

SEQ ID NO: 4338 - DNA, 664 bp, Homo sapiens; identical to SEQ ID NO: 551

SEQ ID NO: 4339 - DNA, 521 bp, Homo sapiens; identical to SEQ ID NO: 2841

SEQ ID NO: 4340 - DNA, 529 bp, Homo sapiens; identical to SEQ ID NO: 3323

SEQ ID NO: 4341 - DNA, 441 bp, Homo sapiens
ccaggactcagcccatcctgaggaggacacgtgtcctcatggagagggtgctccggcccaggcgggggagtcggtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcctttggctgcagtgggggtggatttc

SEQ ID NO: 4342 - DNA, 447 bp, Homo sapiens; identical to SEQ ID NO: 3326

SEQ ID NO: 4343 - DNA, 184 bp, Homo sapiens
gtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagttttt

SEQ ID NO: 4344 - DNA, 324 bp, Homo sapiens
ctgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagagg

SEQ ID NO: 4345 - DNA, 297 bp, Homo sapiens
ccaaatcattatcttgctgcattttaccctatcatagcacactcccaatttctttcatgagtcattggtaatgagagttctgagtacttgttaatcttgctgtacttgtcaatttaaagcagtatcgttttcaaaacaaagcttgattatcattgacctgaactgagagttctttatttagtgctcaataattacatttaacgacttaagttcttaaaaatttaaagtttgattatactttggaggatcacagattgttccataaccttaagcctccaactatttccgactttcact

SEQ ID NO: 4346 - DNA, 377 bp, Homo sapiens; identical to SEQ ID NO: 3327

SEQ ID NO: 4347 - DNA, 526 bp, Homo sapiens
taagctcgggaattcggtcgagcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaat

SEQ ID NO: 4348 - DNA, 550 bp, Homo sapiens; identical to SEQ ID NO: 3328

SEQ ID NO: 4349 - DNA, 509 bp, Homo sapiens; identical to SEQ ID NO: 3330

SEQ ID NO: 4350 - DNA, 593 bp, Homo sapiens; identical to SEQ ID NO: 3331

SEQ ID NO: 4351 - DNA, 537 bp, Homo sapiens; identical to SEQ ID NO: 3332

SEQ ID NO: 4352 - DNA, 564 bp, Homo sapiens
aagctcggaattcggctcgaggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagcc

SEQ ID NO: 4353 - DNA, 503 bp, Homo sapiens
agcccttctgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgct

SEQ ID NO: 4354 - DNA, 544 bp, Homo sapiens
tgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttacagctg

SEQ ID NO: 4355 - DNA, 269 bp, Homo sapiens
tgcccttcttatcagcatctatctagctacattctgacaggataactgcaaactgaatgattcctgggcatcataatggatgtttctttctacttaggtgtctcccctcctctctgcttatatctagcatgcctgttttgggtggtccctggggttgtgggatttcccaggggctacccttcctgctcttggctagatatctgccttctctaacaatgtcatcaaagattacactttgggaacaggcattttcaaggatacacagcttc

SEQ ID NO: 4356 - DNA, 349 bp, Homo sapiens
tccatatcggctggctgatggtccaggcccatctgtgggtgttcaatgaggaagaccctattcacctgaagtgtcacagatggaagaacactgctctgataaggtcacatatttacagaatggcaaaggcggaagtatttttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccaccctgggtaccaagtctctttctgcttggtgatggtactcctttttgc

SEQ ID NO: 4357 - DNA, 313 bp, Homo sapiens
caacacaaagtatgttgtttgttgttagagggcttgggacatttcactctttgccagcctcagcttaatccaggagacaaagattattttccttattatctcttctgcataggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctg

SEQ ID NO: 4358 - DNA, 382 bp, Homo sapiens
cacatgaattttttgatgttcttcctgtgcataaattacagaaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgc

SEQ ID NO: 4359 - DNA, 547 bp, Homo sapiens; identical to SEQ ID NO: 3333
  misc_feature 123: n = A,T,C or G

SEQ ID NO: 4360 - DNA, 364 bp, Homo sapiens
acagacataccctatgccactgctcgagccttcaagacattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttt

SEQ ID NO: 4361 - DNA, 159 bp, Homo sapiens
ggaatacaactgcctgagccagccagggacagcgtctcctcagggcacttggattggggaagacatattccctcctctgctgcctcccactgaacaggacctcactaaacttctcctggaggggcaaggagagtcagggggagggtccttgggggcaca

SEQ ID NO: 4362 - DNA, 1416 bp, Homo sapiens
cgttgaagacattgtcgggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacatacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttca

SEQ ID NO: 4363 - DNA, 509 bp, Homo sapiens; identical to SEQ ID NO: 3340

SEQ ID NO: 4364 - DNA, 359 bp, Homo sapiens; identical to SEQ ID NO: 3341

SEQ ID NO: 4365 - DNA, 121 bp, Homo sapiens
taaagatttatttctagtttgtgtatttgtatgttgtaagcgtttcctaatctgtgtatatctagatgtttttaataagatgttctattttaaactatgtaaattgactgagatataggag

SEQ ID NO: 4366 - DNA, 188 bp, Homo sapiens
ccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcat

SEQ ID NO: 4367 - DNA, 561 bp, Homo sapiens
cactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttattt

SEQ ID NO: 4368 - DNA, 507 bp, Homo sapiens
cgaattcggctcgagcggctcgagggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgatt

SEQ ID NO: 4369 - DNA, 86 bp, Homo sapiens
agccccccaccaggatcaagaaggagccccagagtccccgcacagacccggccctgtcctgcagcaggaagccgccactcccctac

SEQ ID NO: 4370 - DNA, 310 bp, Homo sapiens; identical to SEQ ID NO: 3342

SEQ ID NO: 4371 - DNA, 527 bp, Homo sapiens
tcggctcgagtgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctatgaggtgaccagggccaccgagggcaagtgggaggtgctcattggctcctcacacatcctcaccccgacccgcttcctggatga

SEQ ID NO: 4372 - DNA, 333 bp, Homo sapiens
ccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttgg

SEQ ID NO: 4373 - DNA, 509 bp, Homo sapiens; identical to SEQ ID NO: 3343

SEQ ID NO: 4374 - DNA, 535 bp, Homo sapiens; identical to SEQ ID NO: 3344

SEQ ID NO: 4375 - DNA, 476 bp, Homo sapiens
gtaagctcggaattcggctcgagacccactgatcctggagaaaaggatggagctgaaaaagatggaatgcttgcagagcatgacctgaggagggaggaacgtggtcaactcacacctgcctcttcctgcagcctcacctctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttc

SEQ ID NO: 4376 - DNA, 596 bp, Homo sapiens; identical to SEQ ID NO: 567

SEQ ID NO: 4377 - DNA, 599 bp, Homo sapiens; identical to SEQ ID NO: 569

SEQ ID NO: 4378 - DNA, 517 bp, Homo sapiens
gtaagctcggaattcgctcgggttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcg

SEQ ID NO: 4379 - DNA, 509 bp, Homo sapiens; identical to SEQ ID NO: 570

SEQ ID NO: 4380 - DNA, 251 bp, Homo sapiens; identical to SEQ ID NO: 3350

SEQ ID NO: 4381 - DNA, 727 bp, Homo sapiens
taagctcgggaattcggctcgagccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccggggattgcagccgttcgggcagggggcaagggctgctgtggtgctgggtgctgtggaaaccgctgcaggatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacacctcactgaggctccactgaccgccgggttacacctgctccttcctggacgctcactcccttgctcgctagaataaactgctttgcgctctca

SEQ ID NO: 4382 - DNA, 153 bp, Homo sapiens
tattgtgaccatttttataaaatacatgttcataaaacagatcaacatatttagcttatacagaaataaagttaactcaatccactcacaagagaatttctattttgtaaaaatgtagcttgtatttcagctttaataaaatctgatgtaagg

SEQ ID NO: 4383 - DNA, 233 bp, Homo sapiens
tcctgccacaagttcagactagtcttctgtaggtgagaaagcgcataatgatattaatatccacctcccaaaccccagagtgtgttacattccagggtgataaacctagaggggccttcttcctcttcccagaggaaattcacttacatttcaagataatgaataatttctctcctgaatgggaggaatgggtaggtcaccagcagctttgataaaagcttggaggcttctaa

SEQ ID NO: 4384 - DNA, 288 bp, Homo sapiens
ctgcttagagaccaatcaacggacactggtttttagacctctatcaatcagtagttagcatccaagagactttgcagaggcgtaggaatgaggctggacagatggcggaaacagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagca

SEQ ID NO: 4385 - DNA, 230 bp, Homo sapiens
  misc_feature 43, 99: n = A,T,C or G
ttctgagacatctttttaaggctcttactgcagctcccctccncaccctcctcttctttgcaaaacagacccaagcagggcaggctcagaccactcgcntctttcagatctttcttgcaattatgataacatgagatttgctgttgtgcttttagagaaaagtctggactcagccacaaactctaataagacctgtacatctgagaacctttcccgttactgcgttttca

SEQ ID NO: 4386 - DNA, 513 bp, Homo sapiens; identical to SEQ ID NO: 3352

SEQ ID NO: 4387 - DNA, 467 bp, Homo sapiens; identical to SEQ ID NO: 3353

SEQ ID NO: 4388 - DNA, 497 bp, Homo sapiens; identical to SEQ ID NO: 3354

SEQ ID NO: 4389 - DNA, 541 bp, Homo sapiens; identical to SEQ ID NO: 575

SEQ ID NO: 4390 - DNA, 383 bp, Homo sapiens; identical to SEQ ID NO: 3356

SEQ ID NO: 4391 - DNA, 130 bp, Homo sapiens
tctctgctgacctctctcagagcgccccttctttggaaatgtgcatagcacctttctacaagagactcttactgtgtcctgagaaagccgtagctcctctcctgcctcacaagggcacggtgcttgcttc

SEQ ID NO: 4392 - DNA, 552 bp, Homo sapiens; identical to SEQ ID NO: 3357

SEQ ID NO: 4393 - DNA, 543 bp, Homo sapiens; identical to SEQ ID NO: 3359

SEQ ID NO: 4394 - DNA, 566 bp, Homo sapiens
taagctcggaattcggctcgaggcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcggtaggcctagacccagcagtccctctctctacctcccagagacctccctgtctccgtctctcccacaccctttccaaacctccctgccgctgacccccctccccacagttcccagcacacactgacctcccctgacccctgtgctgcagattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgag

SEQ ID NO: 4395 - DNA, 520 bp, Homo sapiens
tcggctcgagcccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgct

SEQ ID NO: 4396 - DNA, 411 bp, Homo sapiens
gctcggaattcggctcgagcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggt

SEQ ID NO: 4397 - DNA, 438 bp, Homo sapiens
taagctcgggattcggctcgagccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaag

SEQ ID NO: 4398 - DNA, 75 bp, Homo sapiens
gagcatgaggccctgggaccaggactacgtgcccatgacagacctccgggtggactggttctgatcctctaacac

SEQ ID NO: 4399 - DNA, 79 bp, Homo sapiens; identical to SEQ ID NO: 92
  misc_feature 23: n = A,T,C or G

SEQ ID NO: 4400 - DNA, 276 bp, Homo sapiens
  misc_feature 20, 43, 46, 49, 53, 70, 125, 127, 133, 153, 154, 161, 164,169, 175, 178, 179, 182, 205, 209, 220, 245, 246, 250, 253,254, 255, 257, 259, 262, 263, 266: n = A,T,C or G
tctcttcaggcgtgcaagcnggcccaggccaatggttggggcntanatngtgnctcatcgttcggggganactgaagatacttcatcgctgacctggttgtggggctgtgcactgggcagatcananactganagccccttgccgatctgagnncttggcnaantacanccagcnccnnagntttgaagaggagctgggcagcanggcntaagttgcccngcaggaacttcagaaaaccctttgnncaantannntngnggnnaantcagcccctt

SEQ ID NO: 4401 - DNA, 278 bp, Homo sapiens
gtctggctttgcaacaccttaaacatttattctgtcatagatagtaaagccccatctcagtttatttagtcctgaggttggcagcatggggtttgactatatgagctaaaagatacacaaagagataacgctgtttcataataaacaggaattgactatacaaataggtaaaccagcatatctacctgtatttctcagagtttagatgtgtgctttatgtttacattaaaataaagcctaacgccacagtagatcatctcatactgcattcggatgta

SEQ ID NO: 4402 - DNA, 383 bp, Homo sapiens
caggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaa

SEQ ID NO: 4403 - DNA, 490 bp, Homo sapiens; identical to SEQ ID NO: 579

SEQ ID NO: 4404 - DNA, 415 bp, Homo sapiens
cggctcgagtgaatgactaaagctttgctactggggctgaggattccggctaccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtg

SEQ ID NO: 4405 - DNA, 299 bp, Homo sapiens
ttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatg

SEQ ID NO: 4406 - DNA, 393 bp, Homo sapiens
agctggtggacttcctcagcaggggtaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttac

SEQ ID NO: 4407 - DNA, 325 bp, Homo sapiens
  misc_feature 33, 43, 72, 124, 171, 206, 235, 243, 250, 254, 274, 286,287, 300, 314: n = A,T,C or G
taaactagtaccacataatgagagtgcatgganactatttganagggattttgcaggatcgtggtcttccanatatcctaatctgttaaatcaattacttgatttacaaccaagtcatagttcnccctacctaattgctttcttgtggatatctatgaagacatgctaganaatcagtgtgacaataaggaagacattcttaatanagcattagagtatgtgaaatcctagctanagaaaagncactatnaganaggatatggagatacttggnagttccttcaanncaacacagacagnaatgactcccaacnatgtacagcat

SEQ ID NO: 4408 - DNA, 593 bp, Homo sapiens; identical to SEQ ID NO: 583

SEQ ID NO: 4409 - DNA, 496 bp, Homo sapiens
taagctcggaattcgaattcctgccagatctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaagggggagagtcccctactcccctgatcccccaggttcagactgagctcccccttcccagtagctcttgcatcctcctcccaactctagcctgaattcttttcaataaaaaatacaattc

SEQ ID NO: 4410 - DNA, 586 bp, Homo sapiens; identical to SEQ ID NO: 3365

SEQ ID NO: 4411 - DNA, 592 bp, Homo sapiens; identical to SEQ ID NO: 2633

SEQ ID NO: 4412 - DNA, 245 bp, Homo sapiens; identical to SEQ ID NO: 584

SEQ ID NO: 4413 - DNA, 235 bp, Homo sapiens
gggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctc

SEQ ID NO: 4414 - DNA, 239 bp, Homo sapiens
cttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggact

SEQ ID NO: 4415 - DNA, 257 bp, Homo sapiens
aaaaaggagtcattgattttatttgctgttccaaaatccaggaaatgttggagtttcttttatcaggcctcaaagcagaagaataattctccgtggttcttggctctaccctctagactcttggttttgtcttctgagtcttcctttttcatcaaagctagagtgtgtttttacctgagttcttttctcaggctgcttctttccagtagaattttaggggaactagtggtctctatttgtactgtttctgtcctttt

SEQ ID NO: 4416 - DNA, 602 bp, Homo sapiens
gctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgtt

SEQ ID NO: 4417 - DNA, 563 bp, Homo sapiens
ccacccaccctgagagcaaccagggcatgctgacaaccaggaagggtttggattttgaggccaaaaaccagcacaccctgtacgttgaagtgaccaacgaggccccttttgtgctgaagctgccaacctccacagccaccataatggtccacgtggaggatgtgaatgaggcacctgtgattgtcccaccctccaaagatcgctgaggtccacgagggcatccccactggggagcctgtgtgtgtctacactgcagaagaaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaaca

SEQ ID NO: 4418 - DNA, 486 bp, Homo sapiens
ggctcgagggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctatagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaatttggcagcttcatggaggaggtgcgccaggagctggaggacctggagaggagcctgactgaagagacggcgctgggggagcctgcggctgccgccgctgcactgctgggaggggaagagatttagatctggaccatgctgtgggtagatgt

SEQ ID NO: 4419 - DNA, 511 bp, Homo sapiens; identical to SEQ ID NO: 3369

SEQ ID NO: 4420 - DNA, 553 bp, Homo sapiens; identical to SEQ ID NO: 3371

SEQ ID NO: 4421 - DNA, 401 bp, Homo sapiens; identical to SEQ ID NO: 3372

SEQ ID NO: 4422 - DNA, 595 bp, Homo sapiens; identical to SEQ ID NO: 3373

SEQ ID NO: 4423 - DNA, 571 bp, Homo sapiens
  misc_feature 460: n = A,T,C or G
tgcgctctttgatcttgatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccncagagaagctgcagcagtatcgccaggtacacctcctgccaggcctgtgggaacagggctggtgcgagatcacggcccacctcctggcgctgcccgagcatgatgcccgtg

SEQ ID NO: 4424 - DNA, 296 bp, Homo sapiens
ggaaaagaacatctcagccgggcgtggtggttcacgcctggaatcccagcacttgaggccaggagttccagagcagcctgggcaacgcagtgagagaccccatctctacaaaaaaaaaaaaaaaaaaaaaaaatggaaaatcccgggttaaaaatttcttaacccccaaagggaaccattcccttttaaaacccaccaaaaccaacaattggcttttaaacccaaatcttaaatttttcaaaaaaattttaaggtaccggggtttttttttttaaaaaaaataaaaaaaattttgg

SEQ ID NO: 4425 - DNA, 453 bp, Homo sapiens
ccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgc

SEQ ID NO: 4426 - DNA, 424 bp, Homo sapiens; identical to SEQ ID NO: 591

SEQ ID NO: 4427 - DNA, 446 bp, Homo sapiens; identical to SEQ ID NO: 592

SEQ ID NO: 4428 - DNA, 529 bp, Homo sapiens; identical to SEQ ID NO: 3374

SEQ ID NO: 4429 - DNA, 341 bp, Homo sapiens; identical to SEQ ID NO: 594

SEQ ID NO: 4430 - DNA, 317 bp, Homo sapiens
  misc_feature 230: n = A,T,C or G
gtacttgtgtgtacttgttggtctgtatcttagtttctttggggaggacagggctgtagctgtgaggtcttgtctccagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtanagctggaacgagtgcagagtaggaacgctttgatgcgcatgcacattggggaagatgcgctcctcagggacacaaaggccgagtggg

SEQ ID NO: 4431 - DNA, 517 bp, Homo sapiens; identical to SEQ ID NO: 3375

SEQ ID NO: 4432 - DNA, 345 bp, Homo sapiens
ggtaataaatgaaaattggctaaacttctaattgcactaagtaaattattacctaatattctttgtgtgcttttcttacctgattatgctatgaattaattttgtgaatttcttattatttaaatgtttcactctgacctgtgtcagtatgtttgccatttttagttgcttggttgtttttgttagaaagtaaaatgtattgttgcaccatgcatttgttatgtgtataaaattttttacttcacaaaactgtctataggcaattagcaattagtattaagaagttgtataaattgaaatcactttcatatactaaaaactgtaaaatgagagttattacaaaag

SEQ ID NO: 4433 - DNA, 258 bp, Homo sapiens
gagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtag

SEQ ID NO: 4434 - DNA, 178 bp, Homo sapiens
tgggggaggctggggtgggggtaacaacagagggaagatgccctcagctcccaccaaggagcataaataaaaagagaattgaccccccaggaccctttaatagcccaccagagttgccaccaaacagtgtaaaaacgtgtggtttttactattctgatgaaaataatggatgttctgt

SEQ ID NO: 4435 - DNA, 552 bp, Homo sapiens
taagctcggaattcggctcgagtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatata

SEQ ID NO: 4436 - DNA, 594 bp, Homo sapiens
gaattcctgcagtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagttgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcc

SEQ ID NO: 4437 - DNA, 567 bp, Homo sapiens
tggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacatta

SEQ ID NO: 4438 - DNA, 376 bp, Homo sapiens; identical to SEQ ID NO: 3378

SEQ ID NO: 4439 - DNA, 1083 bp, Homo sapiens
cagcatggtgtgtctgaggctccctggaggctcctgcatggcagttctgacagtgacactgatggtgctgagctccccactggctttggctggggacaccagaccacgtttcttggaggaggttaagtttgagtgtcatttcttcaacgggacggagcgggtgcggttgctggaaagacgcgtccataaccaagaggagtacgcgcgctacgacagcgacgtgggggagtaccgggcggtgacggagctggggcggcctgatgccgagtactggaacagccagaaggacctcctggagcggaggcgtgccgcggtggacacctactgcagacacaactacggggttggtgagagcttcacagtgcagcggcgagttcaacctaaggtgactgtgtatccttcaaagacccagcccctgcagcaccacaacctcctggtctgttctgtgaatggtttctatccaggcagcattgaagtcaggtggttccggaacggccaggaagagaagactggggtggtgtccacgggcctgatccagaatggagactggaccttccagaccctggtgatgctggaaacagttcctcagagtggagaggtttacacctgccaagtggagcacccaagtgtgatgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttccgccaacaggattcctgagctgaagtgcagatgaccacattcaaggaagaacctactgccccagctttgcaggatgaaaagctttgctgcctggctgttattcttccgcaagagagggctttctcaggacctggttgctactggttcagcaactgcagaaaatgtcctcccttgtggcttcctcagctcctgcccttggcctgaagtcccagcattgatggcagtgcctcatcttcaacttttgtgctcccctttgcctaaaccttatggcctcctgtgcatctgtactcaccctgtacca

SEQ ID NO: 4440 - DNA, 320 bp, Homo sapiens; identical to SEQ ID NO: 597

SEQ ID NO: 4441 - DNA, 228 bp, Homo sapiens
agaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaacccacccactc

SEQ ID NO: 4442 - DNA, 583 bp, Homo sapiens; identical to SEQ ID NO: 2727

SEQ ID NO: 4443 - DNA, 506 bp, Homo sapiens
actctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgac

SEQ ID NO: 4444 - DNA, 409 bp, Homo sapiens
tcggctcgaggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattccc

SEQ ID NO: 4445 - DNA, 299 bp, Homo sapiens
atgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccgcctgcacagattatttgcacaggtgggagtatcattagatgtttctggaagtgggag

SEQ ID NO: 4446 - DNA, 7680 bp, Homo sapiens
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 4447 - DNA, 251 bp, Homo sapiens
ttagctttttttcctggccctcctaccacccacacatacactttctcgacacataaaggagatatgtaaactgaggtcccgggtattgctacagcaaagacggtggtcctgattcccacgatactgccagattatacttacgtaatcagagtggctctttgagatccacatgatgtgagttatggtgaagtcacctactgctactcatactgcatataaattagtactagtgacaacggtagcctgccttc

SEQ ID NO: 4448 - DNA, 469 bp, Homo sapiens; identical to SEQ ID NO: 3381

SEQ ID NO: 4449 - DNA, 660 bp, Homo sapiens; identical to SEQ ID NO: 600

SEQ ID NO: 4450 - DNA, 494 bp, Homo sapiens; identical to SEQ ID NO: 601

SEQ ID NO: 4451 - DNA, 559 bp, Homo sapiens; identical to SEQ ID NO: 3384
  misc_feature 500: n = A,T,C or G

SEQ ID NO: 4452 - DNA, 447 bp, Homo sapiens; identical to SEQ ID NO: 3387

SEQ ID NO: 4453 - DNA, 567 bp, Homo sapiens; identical to SEQ ID NO: 603

SEQ ID NO: 4454 - DNA, 404 bp, Homo sapiens
actttgttttaactgtaccttaatcggtcatgttctctgaagtggaatgtggctttcctaggaatgggtcccacaaagactaagtggtaatgatgctgtttggggaaaggtcttttttgcttaattttgctttttaaaactctgatgatcgcttgagcaacaggcaggttatctgcctgggtgaattctggttgaaccgggtcttctaatattcctggttaagtggggactgggtaacgaaaccacttggggtaacatttcaacaattcacttaccaatgtttataagctttccattccctaggcaattctttaaaagccccccaaaacaaaaactttactgaaaatggacacaaataggaaatggactttttccttactgtctatacctcctgaaccttggta

SEQ ID NO: 4455 - DNA, 514 bp, Homo sapiens
aagctcggaattcggctcgaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattattttttttttcagttaaatacaaacttgtttggacgcaaggtaccctttctctttttaaaaactttttatcatgaaaactttcaaatacaaaaataaaatggtaaagtgaacctccatgtacccagcatccagctccagtaaccatcaatgtgtaccattatttcatctctcttcctgcacatgct

SEQ ID NO: 4456 - DNA, 567 bp, Homo sapiens; identical to SEQ ID NO: 3389

SEQ ID NO: 4457 - DNA, 528 bp, Homo sapiens
ggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcag

SEQ ID NO: 4458 - DNA, 311 bp, Homo sapiens
attcactttatacagtactagcattaacaaacttcttgatcttgggggcctctcatttgagccaagtctgttaatatcctgaggagcgcattcagggaaacattctattggcttgacttactcagatgacagcggtctcagctgagcatttgataggggccagtagaatcaattcagagttgttttctaacttttactaaatctatgttatagattttcttggaggaaaagtagaccttgtcagagagccttaattaaagtccataacctagaaacatatgcatcaccagatcaacaactgaaatgggaat

SEQ ID NO: 4459 - DNA, 650 bp, Homo sapiens; identical to SEQ ID NO: 605

SEQ ID NO: 4460 - DNA, 271 bp, Homo sapiens; identical to SEQ ID NO: 606
  misc_feature 224, 229: n = A,T,C or G

SEQ ID NO: 4461 - DNA, 364 bp, Homo sapiens
aggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaact

SEQ ID NO: 4462 - DNA, 445 bp, Homo sapiens
tttataaaggcatttagtttatttttcaaaaaaatactttgctagaagggttgagtactgtaattttacatgatcataatctctaaataaattctttttctgaccaacaggtaccagttaagtgaacagctcgtctaggtctgcttttgtaacacccaaatacaattagcacttctctgctggtattccctgggccgtcttaattatctagaggccaggaggcaaagcctagcacgtaacaaagtatgtgctttgtaactgctgattaattcagtttcttaactaggcagagcaggtcatcagtgtatctaattcacactattaatacactgtcttgctgaagagtctgacctgcccagaaccccgttatggctagcccagggaagcagtaaactgcaaagcagagaaaaggggcagctaagatgaggctagtgctggctgagtc

SEQ ID NO: 4463 - DNA, 312 bp, Homo sapiens; identical to SEQ ID NO: 608

SEQ ID NO: 4464 - DNA, 569 bp, Homo sapiens; identical to SEQ ID NO: 3390
  misc_feature 528: n = A,T,C or G

SEQ ID NO: 4465 - DNA, 444 bp, Homo sapiens
ttcggctcgacaaaatctcaatttgtgtctgtttacagctctctctcctcactgctcacagcaaggggttctgtatcagtggatttcattttgtagctgctgagatgttaaggcaagcctcagcatctgcccctgctgggtgcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaaattacggttaatacttttagacagtaagtccggctggttgcagggctatttgccccgacagcatcagcctgtaacatttcttctctttcctttgtgccactgagtcgttccctggccagaggacataaatggtgctggtaggaggttatc

SEQ ID NO: 4466 - DNA, 581 bp, Homo sapiens
aagctcgggaattcgaattcggcaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccagatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgccttt

SEQ ID NO: 4467 - DNA, 519 bp, Homo sapiens
ttttggacaagtcattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttggga

SEQ ID NO: 4468 - DNA, 551 bp, Homo sapiens
gctcgggccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctactgtgagtccagctgaggcccacccaggtggtccctccagccctggttaggcactg

SEQ ID NO: 4469 - DNA, 1556 bp, Homo sapiens
ggctgggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagaggcaccgtgtaaagaaaatggcaaaataaatatctttccaaggatcatcatcacgatagctaaacagtacttaaatagcggttggaactaggtagcctttcgaattttatgattttttcatatgtggaaatctattacatgtaatacaaaacaaacatgtagtttgaaggcggtcagatttctttgagaaatctttgtagagttaattttatggaaattaaaatcagaattaaatgct

SEQ ID NO: 4470 - DNA, 570 bp, Homo sapiens; identical to SEQ ID NO: 2559

SEQ ID NO: 4471 - DNA, 634 bp, Homo sapiens
aagctcggaattcggctcgaggtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcc

SEQ ID NO: 4472 - DNA, 482 bp, Homo sapiens
tagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgttgtgaataccaagaccacaaatcccataatgtcagcttgat

SEQ ID NO: 4473 - DNA, 356 bp, Homo sapiens
agttatctaagctttgattccttacagcaggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgggtttttttgattgatgttcaatatacccagtacccatggtaggggggggtcatgggcctctgctgggtctcttaggggtcttttccacgggcccctaaaaaagtacaggaggggc

SEQ ID NO: 4474 - DNA, 2019 bp, Homo sapiens
acgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattgggataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaatccttcggattaaacatggaagttatgaagatgctgttcactctggagcccttaatgattgatctgatgttccttttatttataacaatgttaaatgcaatgtcttgtaccttgagttgagtattacacattaaagtaaagtacaagctgtaaacttgggtttttgtgatgtaggaaatggtttccatctgtactttggtcctctgatttcagatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattc

SEQ ID NO: 4475 - DNA, 582 bp, Homo sapiens
taagctcgggaattcgctcgagcggctcgagcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtga

SEQ ID NO: 4476 - DNA, 411 bp, Homo sapiens
  misc_feature 400: n = A,T,C or G
gatctattcatttattttactttctaaggaattgatagaaatataaatgtacatatacctaaaaagtggctatcctacatatgacagcccagaatttactaactccataggttttctggatatttcaagcacacattaaaacaattacagagaggacatacatttatgatttatgcaaattaaggcacatcaattacaatctatttttttaagttagtcagtttaaaaatcttcacttacaaaaattcaaaatatgtccaagctcaactttttagtaggaatgttagtttgttgggtttggccattttcttttttcaccttaaaggtcaaacatgaaacaatgaggaatgtaggtctttgtaaaacacataaatacctgtgatgttttgaatcatttggnccttaaaaata

SEQ ID NO: 4477 - DNA, 556 bp, Homo sapiens; identical to SEQ ID NO: 617

SEQ ID NO: 4478 - DNA, 265 bp, Homo sapiens
  misc_feature 180: n = A,T,C or G
cagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcanagtggagggcaatgtctctattctgcctgcccgatctttaccaaaattcaaggcacctgttacagagggaaggccaagtgctgca

SEQ ID NO: 4479 - DNA, 246 bp, Homo sapiens
atgcatatgtatatgcatataaaagatatatataaaatgggggttataaacaatgaaggaaatagtgatactatctatgtgggaacaatactagtatcctccctttggatgaatacagtagctacagatgcaattctggggactctgttgagcaatagcttaactattgcttggctgcaagcatggataacttgttcaaagaacatgaggagttgtaaatatttaaatacgcaggatttgcaacat

SEQ ID NO: 4480 - DNA, 367 bp, Homo sapiens; identical to SEQ ID NO: 620

SEQ ID NO: 4481 - DNA, 171 bp, Homo sapiens
ttaaaattgagataggttaggcatctatccaatctcccatgccagtaattctacagaaacagattaggttagctagataagcatgtttacaattaaatttatgctgtatccttctaatcaccactttctcatcaaaatgctcacaaatcatctgcatcattgtccattctt

SEQ ID NO: 4482 - DNA, 625 bp, Homo sapiens
ttaggttattgatttgagatctttcttctttttaatttaagcacctgcagctataagcttccctttagcatggctttgagatctttcttctttttaatttaagcatctgcagctgtaagcttccctttagcactgcctttgttgcctcctcctgagtttgggtatgtcatggttttgttttcatttgcttaaacattttttttgtcctattgtaatataattgtgttgtttttaatagaggtaattaatgaaacacataatgaattgtgcttctgtttttataatattttaagcattcttaactcagaaatgtaaattttagaaaaaaattccaggccaggcacagtggctcacacctgtagtcccagcacttgaggaggccgaggtgggaggatcatctgaggtcaggagttggagaccagcctggccaacatggtgaaaccctgtctttactaaaaatagaaaaaaaatatataaaagctagctgggtatcatggcgggtgcctgtaatcccagctactctggaggctgaggcaggagaatcacttgaatctgggaggcggaggttgcagtgagctgaaattgcaccactgcactccagcctgggtgacagaatgagtccatc

SEQ ID NO: 4483 - DNA, 470 bp, Homo sapiens; identical to SEQ ID NO: 622

SEQ ID NO: 4484 - DNA, 514 bp, Homo sapiens; identical to SEQ ID NO: 3400

SEQ ID NO: 4485 - DNA, 521 bp, Homo sapiens; identical to SEQ ID NO: 624

SEQ ID NO: 4486 - DNA, 67 bp, Homo sapiens
cagttcaactgcttactcccaaaacagcctttttgtaatttattttttaagtgggctcctgacaata

SEQ ID NO: 4487 - DNA, 509 bp, Homo sapiens; identical to SEQ ID NO: 3404

SEQ ID NO: 4488 - DNA, 516 bp, Homo sapiens
taagctcggaattcggctcgagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcagga

SEQ ID NO: 4489 - DNA, 458 bp, Homo sapiens; identical to SEQ ID NO: 3405

SEQ ID NO: 4490 - DNA, 616 bp, Homo sapiens
gctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattact

SEQ ID NO: 4491 - DNA, 584 bp, Homo sapiens
taagctcggaattcggctcgaggttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagc

SEQ ID NO: 4492 - DNA, 580 bp, Homo sapiens; identical to SEQ ID NO: 628

SEQ ID NO: 4493 - DNA, 262 bp, Homo sapiens
  misc_feature 164: n = A,T,C or G
cggctcgagtagtaacttgttttcactattgtttctagcccttggaattatttcttttattacatttttccttcagggtttcacatttggcaaagctggagagatcctcaccaagcggctccgatacatggttttccgatccatgctcagacaggatgtgagtnggtttgatgaccctaaaaacaccactggagcattgactaccaggctcgccaatgatgctgctcaagttaaaggggtataggttccaggcttgctgtaa

SEQ ID NO: 4494 - DNA, 236 bp, Homo sapiens
  misc_feature 16, 39, 121, 124, 126: n = A,T,C or G
gattacaggcgtgagnatcacacccagcctccccctttntttcctaataggagactcctgtacctttcttcgttttacctatgtgtcgtgtctgcttacatttccttctcccctcaggctnttntntgggtggtcctccaacctccaatacccaggcctggcctcttcagagtaccccccattccactttccctgcctccttccttaaatagctgacaatcaaattcatgctatgg

SEQ ID NO: 4495 - DNA, 853 bp, Homo sapiens
ctagtcctgacttcacttctgatgaggaagcctctctccttagccttcagcctttcctcccaccctgccataagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgtcactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 4496 - DNA, 497 bp, Homo sapiens; identical to SEQ ID NO: 631

SEQ ID NO: 4497 - DNA, 250 bp, Homo sapiens
  misc_feature 236, 240: n = A,T,C or G
cttgtttctttgatactcttgctgtaggtcgccgtgaggggtagggaagcatatatactgtagggagaagtatcaaaatcatttaaggtcttttttccaaactagtgttcccctcccacatcccaataactcttggaagtctggtgctccctctaggtgaaaatcatttgctggcttatggagtcactgttgctgagtcccatcccccagttacagtgcagtggaaaaacaggttnagantctagaactt

SEQ ID NO: 4498 - DNA, 384 bp, Homo sapiens; identical to SEQ ID NO: 3409

SEQ ID NO: 4499 - DNA, 618 bp, Homo sapiens
taagctcggaaattcggctcgagcgagggccccatcgatgccgccttcacccgcatcaactgtcaggggaagacctacctcttcagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgt

SEQ ID NO: 4500 - DNA, 463 bp, Homo sapiens
  misc_feature 385: n = A,T,C or G
tgttgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcagtttaagaccagagccaaattatcccaagagcatacattcnttttggttttcctaactttgtgaaaaaaattgatgcagctgtttttaacccacgtttttataggacctacttctttgt

SEQ ID NO: 4501 - DNA, 732 bp, Homo sapiens
tgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagc

SEQ ID NO: 4502 - DNA, 371 bp, Homo sapiens; identical to SEQ ID NO: 3410

SEQ ID NO: 4503 - DNA, 240 bp, Homo sapiens
ccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttatta

SEQ ID NO: 4504 - DNA, 376 bp, Homo sapiens
tgggaaggacctgtacgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgagctcagacctcttccgcagcaccctggagccggtggagaaggccctgcgggatgccaagctggacaaggcccacattcatgacgtcgtcctggtggggggctccacacgcatccccaaggtgcaaaaattgctgcacgacttcttcaacggcaaggagctgaacaggagcatcaaccctgatgaggctgtggcctatggggctgct

SEQ ID NO: 4505 - DNA, 438 bp, Homo sapiens; identical to SEQ ID NO: 3413

SEQ ID NO: 4506 - DNA, 50 bp, Homo sapiens
gattctggaaaacccggacttgtttctcaccagtgaagccacagattatg

SEQ ID NO: 4507 - DNA, 457 bp, Homo sapiens
ggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacaccttagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagattcccttcccaagtaacagcaacatgtgggaatggagactttggtgactggagtgccttcaaccaagccccatcaggccctgttgcttccagtggcgagttctttggcagtgcctcacagccagcggtagaacttgttagtggc

SEQ ID NO: 4508 - DNA, 509 bp, Homo sapiens; identical to SEQ ID NO: 3414

SEQ ID NO: 4509 - DNA, 275 bp, Homo sapiens
  misc_feature 209: n = A,T,C or G
gggtatttaggttcccatatatgaattgtggggggatattaacatttagaccatagcacctactcatgaaagaacattaataattaacacctctagtgagtatttgtgagtctaggatttacagaacataaggatattgtacaaattttaaaagccaaaatgagttttagtattactaaacaacaactgttcagcaggaaaaaaaaganaatagtaatacagaatccctgtaagcattacctgcactaaactgagcacacaattataactcaagc

SEQ ID NO: 4510 - DNA, 552 bp, Homo sapiens
cgaggttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcatctgaggacttaaagaagcatggtgccactgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccaccccca

SEQ ID NO: 4511 - DNA, 493 bp, Homo sapiens
tgtatcgagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacaggtgagtctggagagatggttccccttctgccttgccagagctgagagtggagaaggaa

SEQ ID NO: 4512 - DNA, 581 bp, Homo sapiens
ttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcag

SEQ ID NO: 4513 - DNA, 325 bp, Homo sapiens
ggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcct

SEQ ID NO: 4514 - DNA, 504 bp, Homo sapiens
ccacgtaagatcatccgcatgtgggcagaaaaagaatgcacaatctcgcaagatgcagagagctggaattccttgtccaacagttgtactacatgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttgg

SEQ ID NO: 4515 - DNA, 603 bp, Homo sapiens
cgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctc

SEQ ID NO: 4516 - DNA, 564 bp, Homo sapiens
cgagtaaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctctt

SEQ ID NO: 4517 - DNA, 581 bp, Homo sapiens
gagcctttgtgctctcaccgccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagt

SEQ ID NO: 4518 - DNA, 500 bp, Homo sapiens
ggatcgaggcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccg

SEQ ID NO: 4519 - DNA, 597 bp, Homo sapiens; identical to SEQ ID NO: 3416

SEQ ID NO: 4520 - DNA, 425 bp, Homo sapiens; identical to SEQ ID NO: 3417

SEQ ID NO: 4521 - DNA, 494 bp, Homo sapiens
cttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctc

SEQ ID NO: 4522 - DNA, 166 bp, Homo sapiens
  misc_feature 87: n = A,T,C or G
tgccgaaatagcttcagagtaattatgaattgccttccaaaaaccactgttttgcacttgcctgcaagaataggaaaaacaaaaggnctgtaaggtggcaggatggcagaaccaaacaagagtagtacaccttggagttttttcgaaatatgggttgggtttttgg

SEQ ID NO: 4523 - DNA, 620 bp, Homo sapiens; identical to SEQ ID NO: 646

SEQ ID NO: 4524 - DNA, 353 bp, Homo sapiens
caggttcactgggaccagggctacaggcacagagtctcctggaaaaggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctt

SEQ ID NO: 4525 - DNA, 67 bp, Homo sapiens
atcgcctcgggggacggagcggaggatacagttctggaaaacaaggcagaagtgatagttcaagtaa

SEQ ID NO: 4526 - DNA, 366 bp, Homo sapiens
agacccccgcgcaaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctg

SEQ ID NO: 4527 - DNA, 105 bp, Homo sapiens
ccctgccgcaccacagtgccaatgcttgtgaggacacatgcccttcgggagccttccagaacaggagggaagacaaagagaaaactttcttcccttctactaaaa

SEQ ID NO: 4528 - DNA, 84 bp, Homo sapiens
atacttcatccctacctttcacctggtagccagagccaaaacactggggattgacatcatggatgcctcttaccttgtttctgt

SEQ ID NO: 4529 - DNA, 249 bp, Homo sapiens; identical to SEQ ID NO: 3421

SEQ ID NO: 4530 - DNA, 396 bp, Homo sapiens
gctcgggaattcgaattctgacatcgctggccttcttggggacatgcttttgctcaggtgacctgttccagcccaggcagagatcaggtgggcagaggctggcagtgctgattcagcctggccatccccagaggtgacccaatgctcctggagggggcaagcctgtatagacagcacttggctccttaggaacagctcttcactcagccacaccccacattggacttccttggtttggacacagtgctccagctgcctgggaggcttttggtggtccccacagcctctgggccaagactcctgtcccttcttgggatgagaatgaaagcttaggctgcttattggaccagaagtcctatcgactttatacagaactgaattaagttattgattttt

SEQ ID NO: 4531 - DNA, 636 bp, Homo sapiens
gcagccaagtcgaaagagagctagctcagaaaagaaaagagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagc

SEQ ID NO: 4532 - DNA, 1448 bp, Homo sapiens
  misc_feature 410, 1096, 1134, 1433: n = A,T,C or G
attgattaaaaggtgacctttcttattggactgataagacaaaaatatagattccaaatctattgacatatgatatcacatccacaaatgtttgcctatttttgtagcattattttggttgcaaagtctcttagggaatgcacaaaaataatacaaccttaaaaatcagactagaagatggaatataagtggtttccttgtaatttttttttaagcttggagaggtaataacacatctttgaattcaaactgaggactgctgcttaatggtgcttttacagggtggttctaaaatttttgagagtcaggtattgctttctctgactgtttaattcaccactggcacgtgtttcctatcctcaagcataagtttaaaagattacaaacctcatgctgctcagttttttctntccagtaaatcagatgcatggtttctctaaatttacatatagaaaatcgagatgtggtgggtattagactaacacttcagtgataggaagaagagactgatttctcatatttgtgtaaaacattctcttacctaactaccatctggtccacattaatttcctctcatagccatagctttccattaccaatgagttttccatgtattcacagcatatgggccaggaaatctttctacagagaatgtgtcccttaggcatatatttcccctagattaccgtattaagaaatgttctccctaaaccatacttatggcattaccataaaattgcctcttgaacacagttaaattgaaagtgctcaaaatgcatatcaattcaggtaaaagaaatcttgctacttggaggggaggtattttttattcttccccactttctctttctaactccctacaaagctatttctaattatttgcttatgctgggcactgaattttctcttaggctgaccatatattttattaaagtagtcttgaattcaggagtggaaaaaaaaaagttatgttttagacctcaatgtaagctgaaaggaaataaaggaacttctatatttccatttctcaggctgattttccttcccctgttctcttatctgtatcatgacatgagacgtgaacctcagaaatgtnaaaacaaaaagtcctagaataaagcattcccttgaatnttaaatgaacatgcttttagcagcctggatacgaagcagactattttcaacaaattgaatgtttccccacttgtgtgagagccaaacaagtgccatacagaaagggacctcttcaatgttaccaaagctttgtggcagcatttaagtgtggtggcgccatagaagtcactatagcatggacgagccacttggcttgctttttcctgctaatcaaagttttaagaagataaaaagctatctttgttatatatgttttgtctaatttgcaatattacagtctcctggggggaaatccaacntccaataataattgt

SEQ ID NO: 4533 - DNA, 607 bp, Homo sapiens; identical to SEQ ID NO: 3424

SEQ ID NO: 4534 - DNA, 572 bp, Homo sapiens; identical to SEQ ID NO: 3425

SEQ ID NO: 4535 - DNA, 357 bp, Homo sapiens; identical to SEQ ID NO: 3426

SEQ ID NO: 4536 - DNA, 574 bp, Homo sapiens; identical to SEQ ID NO: 3427

SEQ ID NO: 4537 - DNA, 548 bp, Homo sapiens
tcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcag

SEQ ID NO: 4538 - DNA, 349 bp, Homo sapiens
  misc_feature 162: n = A,T,C or G
gcagttgaaaaattgaaggatttagagctagaaggcatcactggagcagaaagaaacagcatagccttcaggtcaacttgatactcttcccccatctcattgcttctcactagaatagccacattcataattggaagcctagccagctcaggccaaagttantcattagtccaagggaaaaatgaccgaaaaaggacagcatagtgagttttgtgtaaaagctcatttaaagatcgtcttatttggagatggtgtgccccgcattttagtgttacaatgtatttgagagctgatgctgataataaatggctattttattaaatgctctagtttggcaaaattaaaagtt

SEQ ID NO: 4539 - DNA, 304 bp, Homo sapiens
agagattctttattagttgggcattctttatgaccttttctataaaacagtaaggacattaaaatgtaagatgcatgacaaaaatataagtggagaggctcattgtagttaacctatattaagtaatgtttaaggtaggtgttcagagtaatacttttctacattatactgagagaaagaaattataaattaaagtatatcaattattttactaattttactgttacgtaataaaatgcaatatatttaaaaattgttagattatgtgtgaacttaacttatattttatttacttacttaactt

SEQ ID NO: 4540 - DNA, 393 bp, Homo sapiens
agatactacctgtggcaagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaacgggagtaccctatttttcggggagcagggggaaaactttccctcctacccagg

SEQ ID NO: 4541 - DNA, 259 bp, Homo sapiens; identical to SEQ ID NO: 657

SEQ ID NO: 4542 - DNA, 342 bp, Homo sapiens; identical to SEQ ID NO: 3430

SEQ ID NO: 4543 - DNA, 188 bp, Homo sapiens
ctgcatcagtaattttaataaagaaaagcatgctctgagagaaagctcgctccttggtctgcagtcctttaaacaaagcagtgcagttcttagccaagggtaagtactgcaactgtcgagagcatcttgtcttccacacagttgggtgactctccgttttgacacaaagataagccttgcccttgttt

SEQ ID NO: 4544 - DNA, 500 bp, Homo sapiens
tgtccaacttcatcaaggcatggtcagctacagcatgaaccctgtggacctgttcgaggccaacgacctgtttgagagtgggaacatgacgcaggtgcaggtgtctcttctcgccctggctgggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccaaccagtcgggcatgactgcgtacggcacgaggaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcg

SEQ ID NO: 4545 - DNA, 292 bp, Homo sapiens
acagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggact

(The sequence listing continues in the following parts.)

That which is claimed is:

1. A method for assessing the colorectal tumor burden of a subject, said method comprising: comparing a level of a DKFZ gene product in a patient sample to a control, wherein an increase in the level of the DKFZ gene product in the patient sample relative to the control is indicative of an increased colorectal tumor burden in the subject,
    wherein the DKFZ gene product is a nucleic acid comprising a nucleotide sequence of SEQ ID NO: 3018, or a full complement thereof, or a polypeptide comprising an amino acid sequence of SEQ ID NO: 3017.

2. The method of claim 1, wherein the increase in the level of the DKFZ gene product in the patient sample relative to the control that is indicative of an increased tumor burden in the subject is at least a 1.5 fold increase.

3. A method for detecting a cancerous cell, said method comprising:
    comparing a level of DKFZ gene product in a patient sample to a control,
    wherein an increase in the level of DKFZ gene product in the patient sample relative to the control is indicative of the presence of a cancerous cell,
    wherein the DKFZ gene product is a nucleic acid comprising a nucleotide sequence of SEQ ID NO: 3018, or a full complement thereof, or a polypeptide comprising an amino acid sequence of SEQ ID NO: 3017, and
    wherein the cancerous cell is a colorectal cancer cell.

4. The method of claim 3, wherein the increase in the level of DKFZ gene product in the patient sample relative to the control that is indicative of the presence of a cancerous cell is at least a 1.5 fold increase.

5. A method of diagnosing colorectal cancer in a patient, said method comprising: comparing a level of DKFZ gene product in a patient sample to a control level, said DKFZ gene product comprising a nucleotide sequence of SEQ ID NO:3018, or a full complement thereof, wherein an increase in the level of DKFZ gene product in the patient sample relative to the control level is indicative of the presence of colorectal cancer in the patient.

6. The method of claim 5 wherein the increase in the level of DKFZ gene product in the patient sample relative to the control level that is indicative of the presence of colorectal cancer in the patient is at least a 1.5 fold increase.

7. A method of diagnosing colorectal cancer in a patient, said method comprising:
    (a) contacting a polynucleotide that binds to mRNA encoding a DKFZ polypeptide comprising an amino acid sequence of SEQ ID NO: 3017 with nucleic acids of a biological sample acquired from said patient under binding conditions suitable to form a duplex; and
    (b) comparing the amount of the duplex formed to the amount of duplex formed when the polynucleotide is contacted with nucleic acids of a biological sample acquired from a normal control, wherein an increase in the amount of duplex formed upon contacting said polynucleotide and said nucleic acids of the biological sample acquired from said patient compared to the amount of duplex formed upon contacting said polynucleotide and said nucleic acids of the biological sample acquired from a normal control is indicative of the presence of cancer in said patient.

8. The method of claim 7 wherein the presence of cancer is indicated by at least a two-fold increase in the amount of duplex formed from the patient sample as compared to the amount of duplex formed from the normal control.

9. The method of claim 7, wherein the increase in the amount of duplex formed upon contacting said polynucleotide and said nucleic acids of the biological sample acquired from said patient compared to the amount of duplex formed upon contacting said polynucleotide and said nucleic acids of the biological sample acquired from a normal control that is indicative of the presence of cancer in said patient is at least a 1.5 fold increase.

* * * * *